US007915400B2

(12) United States Patent
McSwiggen et al.

(10) Patent No.: US 7,915,400 B2
(45) Date of Patent: Mar. 29, 2011

(54) RNA INTERFERENCE MEDIATED INHIBITION OF HEPATITIS C VIRUS (HCV) GENE EXPRESSION USING SHORT INTERFERING NUCLEIC ACID (SINA)

(75) Inventors: James McSwiggen, Boulder, CO (US); Leonid Beigelman, Brisbane, CA (US)

(73) Assignee: Merck Sharp & Dohme Corp., Rahway, NJ (US)

( * ) Notice: Subject to any disclaimer, the term of this patent is extended or adjusted under 35 U.S.C. 154(b) by 0 days.

(21) Appl. No.: 12/137,411

(22) Filed: Jun. 11, 2008

(65) Prior Publication Data
US 2009/0156528 A1 Jun. 18, 2009

Related U.S. Application Data

(63) Continuation of application No. 10/667,271, filed on Sep. 16, 2003, now abandoned, which is a continuation-in-part of application No. 10/444,853, filed on May 23, 2003, which is a continuation-in-part of application No. PCT/US03/05043, filed on Feb. 20, 2003, which is a continuation-in-part of application No. PCT/US02/09187, filed on Mar. 26, 2002.

(60) Provisional application No. 60/401,104, filed on Aug. 5, 2002, provisional application No. 60/358,580, filed on Feb. 20, 2002, provisional application No. 60/363,124, filed on Mar. 11, 2002, provisional application No. 60/386,782, filed on Jun. 6, 2002, provisional application No. 60/406,784, filed on Aug. 29, 2002, provisional application No. 60/408,378, filed on Sep. 5, 2002, provisional application No. 60/409,293, filed on Sep. 9, 2002, provisional application No. 60/440,129, filed on Jan. 15, 2003.

(51) Int. Cl.
*C07H 21/04* (2006.01)
*C07H 21/02* (2006.01)
*A61K 48/00* (2006.01)

(52) U.S. Cl. ........................ 536/24.5; 536/23.1; 514/44

(58) Field of Classification Search ........................ None
See application file for complete search history.

(56) References Cited

U.S. PATENT DOCUMENTS

| | | | |
|---|---|---|---|
| 5,814,620 | A | 9/1998 | Robinson et al. |
| 5,998,203 | A | 12/1999 | Matulic-Adamic et al. |
| 5,998,206 | A | 12/1999 | Cowsert |
| 6,346,398 | B1 | 2/2002 | Pavco et al. |
| 2004/0053875 | A1 | 3/2004 | Kreutzer et al. |
| 2005/0020521 | A1 | 1/2005 | Rana |
| 2005/0058982 | A1* | 3/2005 | Han et al. ............ 435/5 |
| 2005/0080246 | A1 | 4/2005 | Allerson et al. |
| 2006/0134189 | A1* | 6/2006 | MacLachlan et al. .......... 424/450 |

FOREIGN PATENT DOCUMENTS

| | | |
|---|---|---|
| CA | 2359180 | 3/2000 |
| WO | WO90/14090 | 11/1990 |
| WO | WO94/01550 | 1/1994 |
| WO | WO99/29350 | 6/1999 |
| WO | WO99/32619 | 7/1999 |
| WO | WO99/49029 | 9/1999 |
| WO | WO00/44895 | 8/2000 |
| WO | WO01/36646 | 5/2001 |
| WO | WO01/68836 | 9/2001 |
| WO | WO01/75164 | 10/2001 |
| WO | WO01/96584 | 3/2002 |
| WO | WO02/22636 | 3/2002 |
| WO | WO02/44321 | 6/2002 |
| WO | WO03/016572 | 2/2003 |
| WO | WO03/064626 | 8/2003 |

OTHER PUBLICATIONS

Elbashir et al., Functional anatomy of siRNAs for mediating efficienct RNAi in *Drosophila melanogaster* embryo lysate, 2001, The EMBO Journal, vol. 20, No. 23, pp. 6877-6888.*
Anderson et al. "Bispecific Short Hairpin siRNA Constructs Targeted to CD4, CXCR4, and CCR5 Confer HIV-1 Resistance," Oligonucleotides 13(5):303-312 (2003).
Elbashir et al. "Analysis of Gene Function in Somatic Mammalian Cells Using Small Interfering RNAs," Methods 26 (2):199-213 (2002).
Elbashir et al. "Duplexes of 21-Nucleotide RNAs Mediate RNA Interference in Cultured Mammalian Cells," Nature 411(6836):494-498 (2001).
Elbashir et al. "Functional Anatomy of siRNAs for Mediating Efficient RNAi in *Drosophila melanogaster* Embryo Lysate," EMBO J. 20(23):6877-6888 (2001).
Elbashir et al. "RNA Interference is Mediated by 21- and 22-Nucleotide RNAs," Genes Dev. 15(2):188-200 (2001).
Fire et al. "Potent and Specific Genetic Interference by Double-Stranded RNA in *Caenorhabditis elegans*," Nature 391:806-811 (1998).
Futami et al. "Induction of Apoptosis in HeLa Cells with siRNA Expression Vector Targeted Against BcI-2," Nucleic Acids Research Supplement 2:251-252 (2002).
International Search Report mailed on Mar. 31, 2005 for PCT/US04/16390, 2 pages.

(Continued)

*Primary Examiner* — Amy Bowman
(74) *Attorney, Agent, or Firm* — Laura M. Ginkel; David A. Muthard

(57) ABSTRACT

The present invention concerns methods and reagents useful in modulating hepatitis C virus (HCV) gene expression in a variety of applications, including use in therapeutic, diagnostic, target validation, and genomic discovery applications. Specifically, the invention relates to small nucleic acid molecules, such as short interfering nucleic acid (siNA), short interfering RNA (siRNA), double-stranded RNA (dsRNA), micro-RNA (miRNA), and short hairpin RNA (shRNA) molecules capable of mediating RNA interference (RNAi) against hepatitis C virus (HCV) gene expression and/or activity. The small nucleic acid molecules are useful in the treatment and diagnosis of HCV infection, liver failure, hepatocellular carcinoma, cirrhosis and any other disease or condition that responds to modulation of HCV expression or activity.

5 Claims, 24 Drawing Sheets

OTHER PUBLICATIONS

International Search Report mailed on Oct. 17, 2003 for PCT/US03/05028, 2 pages.
International Search Report mailed on Oct. 17, 2003 for PCT/US03/05346, 1 page.
Leirdal et al. "Gene Silencing in Mammalian Cells by Preformed Small RNA Duplexes," Biochemical and Biophysical Research Communications 295:744-748 (2002).
Lin et al. "A Novel mRNA-cDNA Interference Phenomenon for Silencing Bcl-2 Expression in Human LNCaP Cells," Biochemical and Biophysical Research Communications 281:639-644 (2001).
Tuschl et al. "Small Interfering RNAs: A Revolutionary Tool for the Analysis of Gene Function and Gene Therapy," Molecular Interventions 295(3):158-167 (2002).
Tuschl et al. "Targeted mRNA Degradation by Double-Stranded RNA In Vitro," Genes and Development 13 (24):3191-3197 (1999).
Office Action mailed on Feb. 4, 2008 for U.S. Appl. No. 10/444,853, 37 pages.
Office Action mailed on Jul. 1, 2008 for U.S. Appl. No. 11/499,520, 13 pages.
Office Action mailed on Oct. 8, 2008 for U.S. Appl. No. 11/499,529, 34 pages.
Office Action mailed on Nov. 14, 2008 for U.S. Appl. No. 11/502,875, 14 pages.
Office Action mailed on Apr. 8, 2009 for U.S. Appl. No. 11/502,876, 31 pages.
Office Action mailed on Jan. 26, 2009 for U.S. Appl. No. 11/676,124, 15 pages.
Office Action mailed on Feb. 3, 2009 for U.S. Appl. No. 10/693,059, 7 pages.
Office Action mailed on Jul. 2, 2008 for U.S. Appl. No. 10/757,803, 26 pages.
Office Action mailed on Apr. 16, 2009 for U.S. Appl. No. 12/105,010, 24 pages.
McCaffrey, et al., Nature, vol. 418, pp. 38-39 (2002).
Randall, et al., PNAS, vol. 100(1), pp. 235-240 (2003).
Bass, et al., Nature, vol. 411, pp. 428-429 (2001).
Kapadia, et al., PNAS, vol. 100(4), pp. 2014-2018 (2003).
Kennerdell, Nature Biotech., vol. 18(8), pp. 896-898 (2000).
Tavernarakis, et al., Nature Genetics, vol. 24(2), pp. 180-183 (2000).
Parrish, et al., Molecular Cell 6, pp. 1077-1087 (2000).
Wu, et al., Croatian Med. Journal, vol. 42(4), pp. 463-466 (2001).
Hammond, et al., Nature Rev. Genet., vol. 2(2), pp. 110-119 (2001).
Caplen, Expert Opin. Biol. Ther., vol. 3(4), pp. 575-586 (2003).
Kurreck, et al., Nucleic Acid Res., vol. 30(9), pp. 1911-1918 (2002).
Bertrand, et al., Biochemical and Biophysical Research Communications, vol. 296, pp. 1000-1004 (2002).
Braasch, et al., Biochemistry, vol. 41(14), pp. 4503-4570 (2002).
Olie, et al., Biochemica et Biophysica Acta, vol. 1576, pp. 101-109 (2002).
Office Action mailed Dec. 18, 2007 in U.S. Appl. No. 10/667,271, 43 pgs.
Request for Continued Examination with 1.114(c) Amendment filed Oct. 18, 2007 in U.S. Appl. No. 10/667,271, 27 pgs.
Final Office Action mailed Apr. 18, 2007 in U.S. Appl. No. 10/667,271, 8 pgs.
1.111 Amendment filed Feb. 28, 2007 in U.S. Appl. No. 10/667,271, 12 pgs.
Office Action mailed Aug. 28, 2006 in U.S. Appl. No. 10/667,271, 13 pgs.

\* cited by examiner

Figure 1
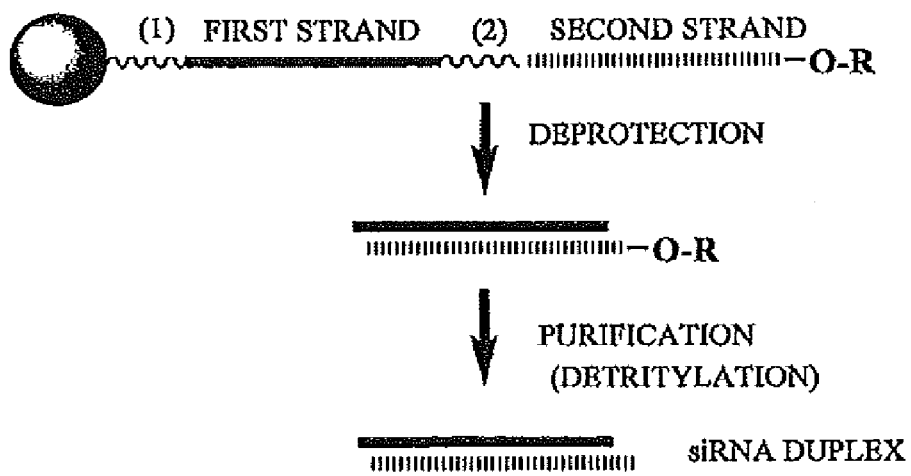
○ = SOLID SUPPORT
R = TERMINAL PROTECTING GROUP
FOR EXAMPLE:
DIMETHOXYTRITYL (DMT)
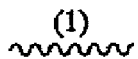 = CLEAVABLE LINKER
(FOR EXAMPLE: NUCLEOTIDE SUCCINATE OR
INVERTED DEOXYABASIC SUCCINATE)
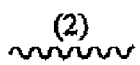 = CLEAVABLE LINKER
(FOR EXAMPLE: NUCLEOTIDE SUCCINATE OR
INVERTED DEOXYABASIC SUCCINATE)
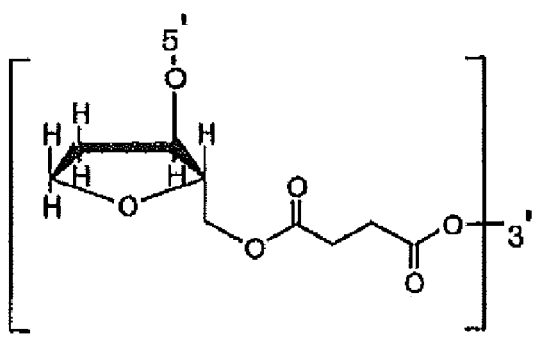
INVERTED DEOXYABASIC SUCCINATE LINKAGE
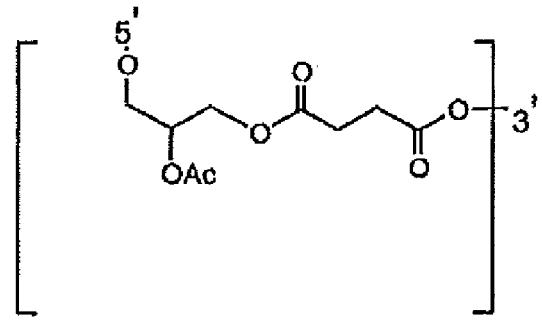
GLYCERYL SUCCINATE LINKAGE

Figure 4

A
- SENSE STRAND (SEQ ID NO 1688)
- ALL POSITIONS RIBONUCLEOTIDE EXCEPT POSITIONS (N N)
- 5'- B-N N N N N N N N N N N N N N N N N (N N)-B -3'
- 3'- L-(N$_s$N) N N N N N N N N N N N N N N N N N N -5'
- ANTISENSE STRAND (SEQ ID NO 1689)
- ALL POSITIONS RIBONUCLEOTIDE EXCEPT POSITIONS (N N)

B
- SENSE STRAND (SEQ ID NO 1690)
- ALL PYRIMIDINES = 2'-FLUORO AND ALL PURINES = 2'-OM EXCEPT POSITIONS (N N)
- 5'- N N N N N N N N N N N N N N N N N (N$_s$N) -3'
- 3'- L-(N$_s$N) N N N N N N N N N N N N N N N N N N -5'
- ANTISENSE STRAND (SEQ ID NO 1691)
- ALL PYRIMIDINES = 2'-FLUORO AND ALL PURINES = 2'-O-ME EXCEPT POSITIONS (N N)

C
- SENSE STRAND (SEQ ID NO 1692)
- ALL PYRIMIDINES = 2'-O-ME OR 2'-FLUORO EXCEPT POSITIONS (N N)
- 5'- B-N N N N N N N N N N N N N N N N N (N N)-B -3'
- 3'- L-(N$_s$N) N N N N N N N N N N N N N N N N N N -5'
- ANTISENSE STRAND (SEQ ID NO 1693)
- ALL PYRIMIDINES = 2'-FLUORO EXCEPT POSITIONS (N N)

D
- SENSE STRAND (SEQ ID NO 1694)
- ALL PYRIMIDINES = 2'-FLUORO EXCEPT POSITIONS (N N) AND ALL PURINES = 2'-DEOXY
- 5'- B-N N N N N N N N N N N N N N N N N (N N)-B -3'
- 3'- L-(N$_s$N) N N N N N N N N N N N N N N N N N N -5'
- ANTISENSE STRAND (SEQ ID NO 1691)
- ALL PYRIMIDINES = 2'-FLUORO AND ALL PURINES = 2'-O-ME EXCEPT POSITIONS (N N)

E
- SENSE STRAND (SEQ ID NO 1695)
- ALL PYRIMIDINES = 2'-FLUORO EXCEPT POSITIONS (N N)
- 5'- B-N N N N N N N N N N N N N N N N N (N N)-B -3'
- 3'- L-(N$_s$N) N N N N N N N N N N N N N N N N N N -5'
- ANTISENSE STRAND (SEQ ID NO 1691)
- ALL PYRIMIDINES = 2'-FLUORO AND ALL PURINES = 2'-O-ME EXCEPT POSITIONS (N N)

F
- SENSE STRAND (SEQ ID NO 1694)
- ALL PYRIMIDINES = 2'-FLUORO EXCEPT POSITIONS (N N) AND ALL PURINES = 2'-DEOXY
- 5'- B-N N N N N N N N N N N N N N N N N (N N)-B -3'
- 3'- L-(N$_s$N) N N N N N N N N N N N N N N N N N N -5'
- ANTISENSE STRAND (SEQ ID NO 1696)
- ALL PYRIMIDINES = 2'-FLUORO EXCEPT POSITIONS (N N) AND ALL PURINES = 2'-DEOXY

POSITIONS (NN) CAN COMPRISE ANY NUCLEOTIDE, SUCH AS DEOXYNUCLEOTIDES (eg. THYMIDINE) OR UNIVERSAL BASES
B = ABASIC, INVERTED ABASIC, INVERTED NUCLEOTIDE OR OTHER TERMINAL CAP THAT IS OPTIONALLY PRESENT
L = GLYCERYL MOIETY THAT IS OPTIONALLY PRESENT
S = PHOSPHOROTHIOATE OR PHOSPHORODITHIOATE n = 0, 1, 2, 3, 4

Figure 9: Target site Selection using siRNA

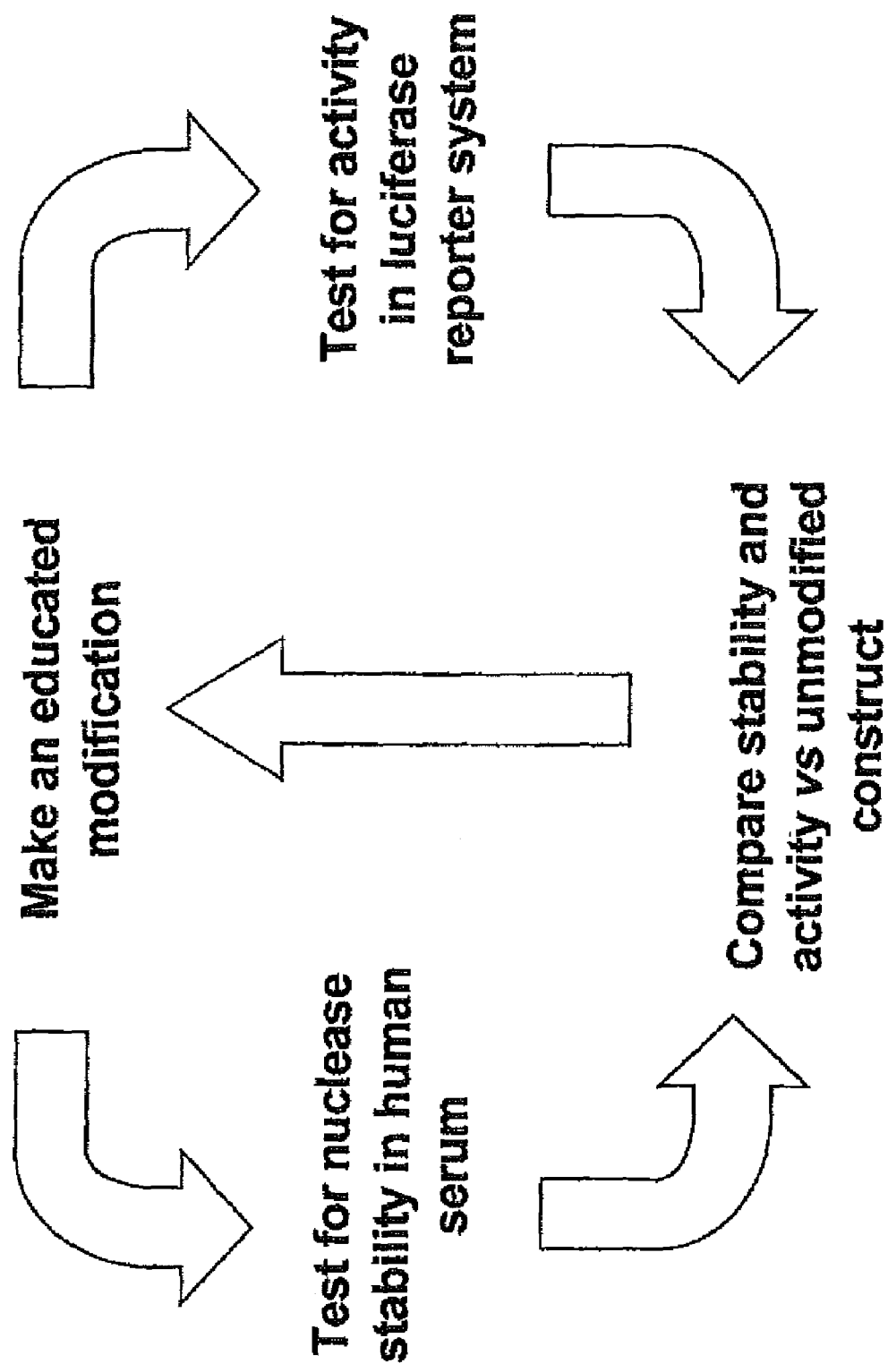
Figure 11: Modification Strategy

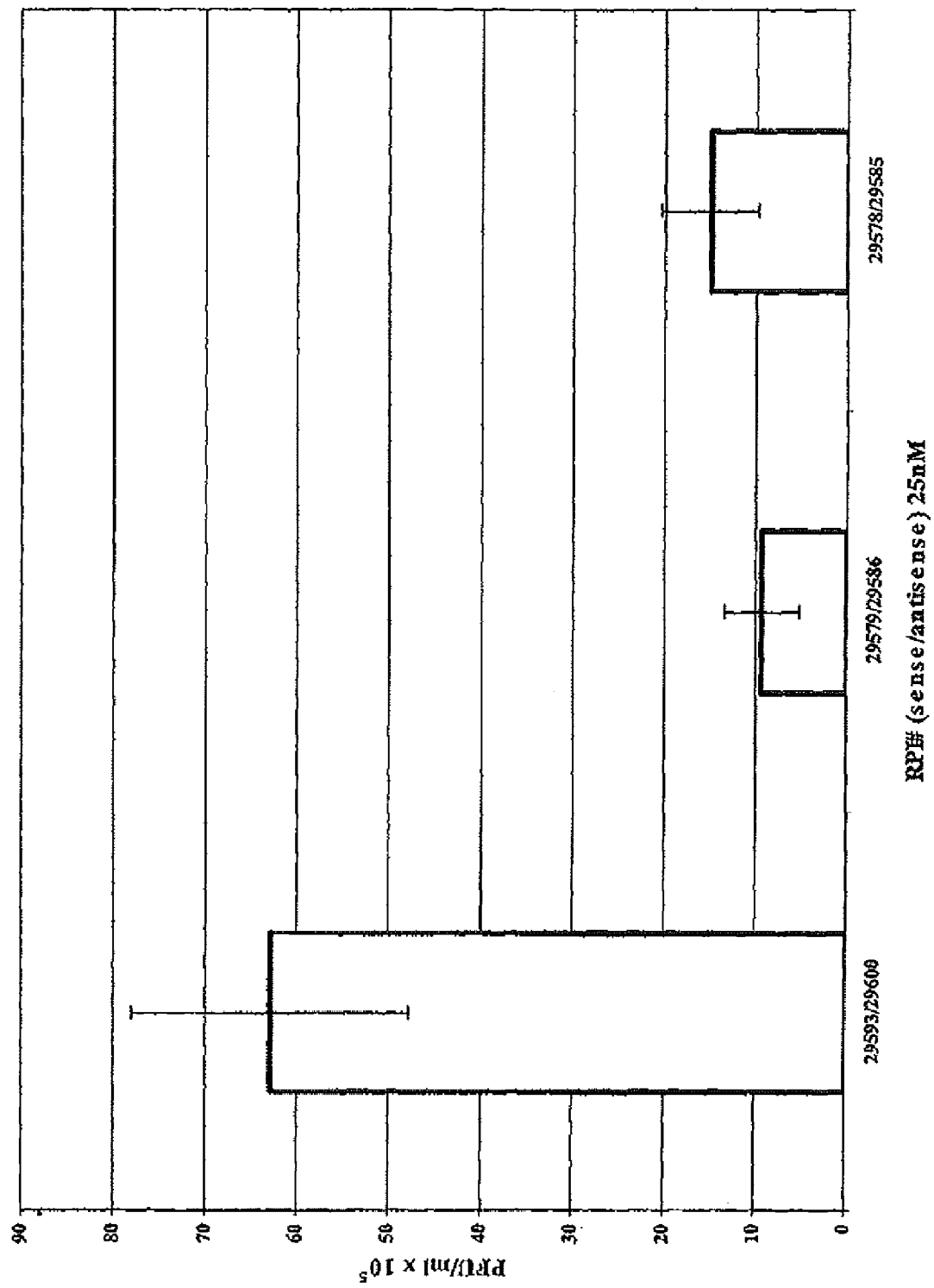

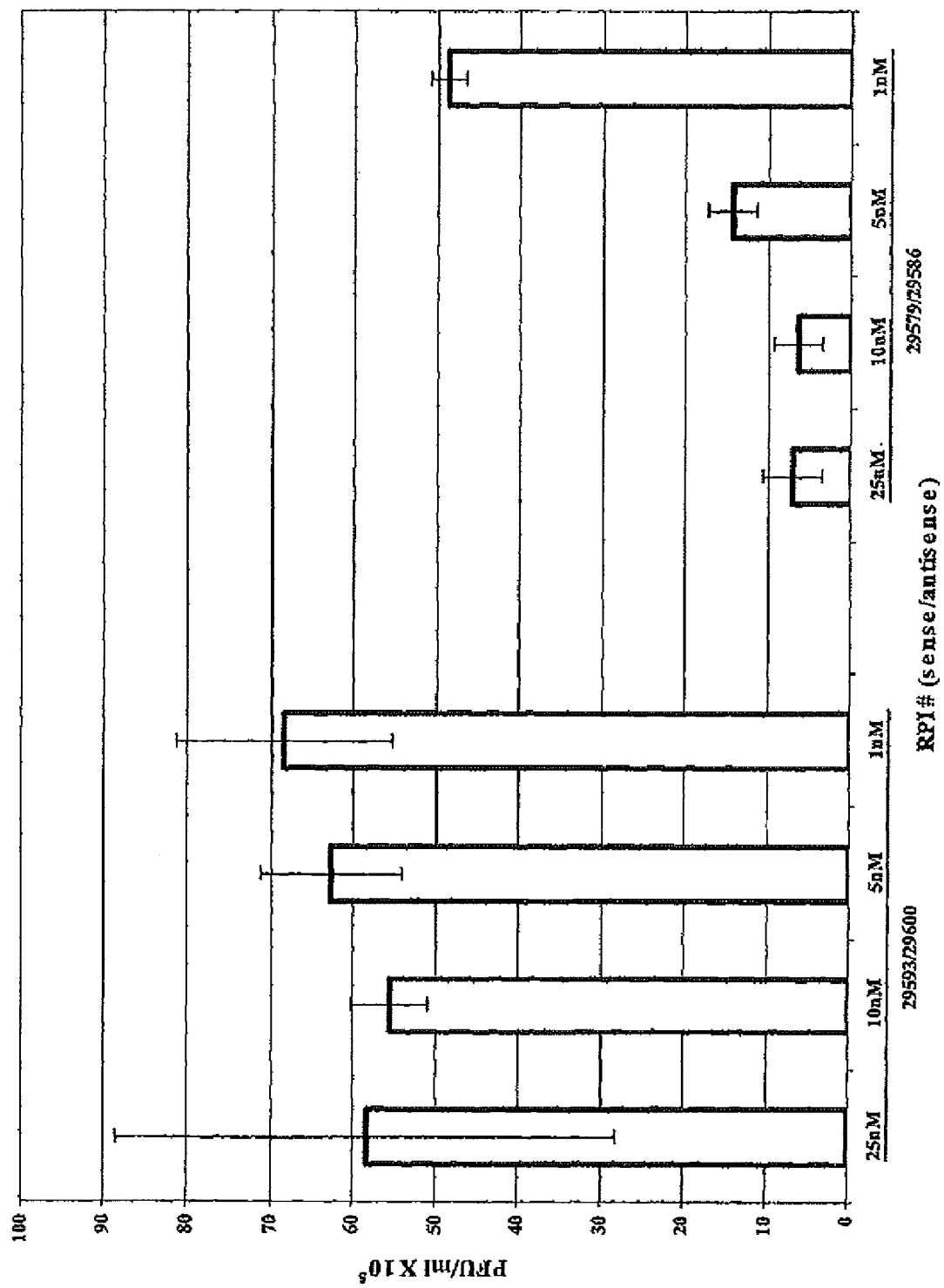

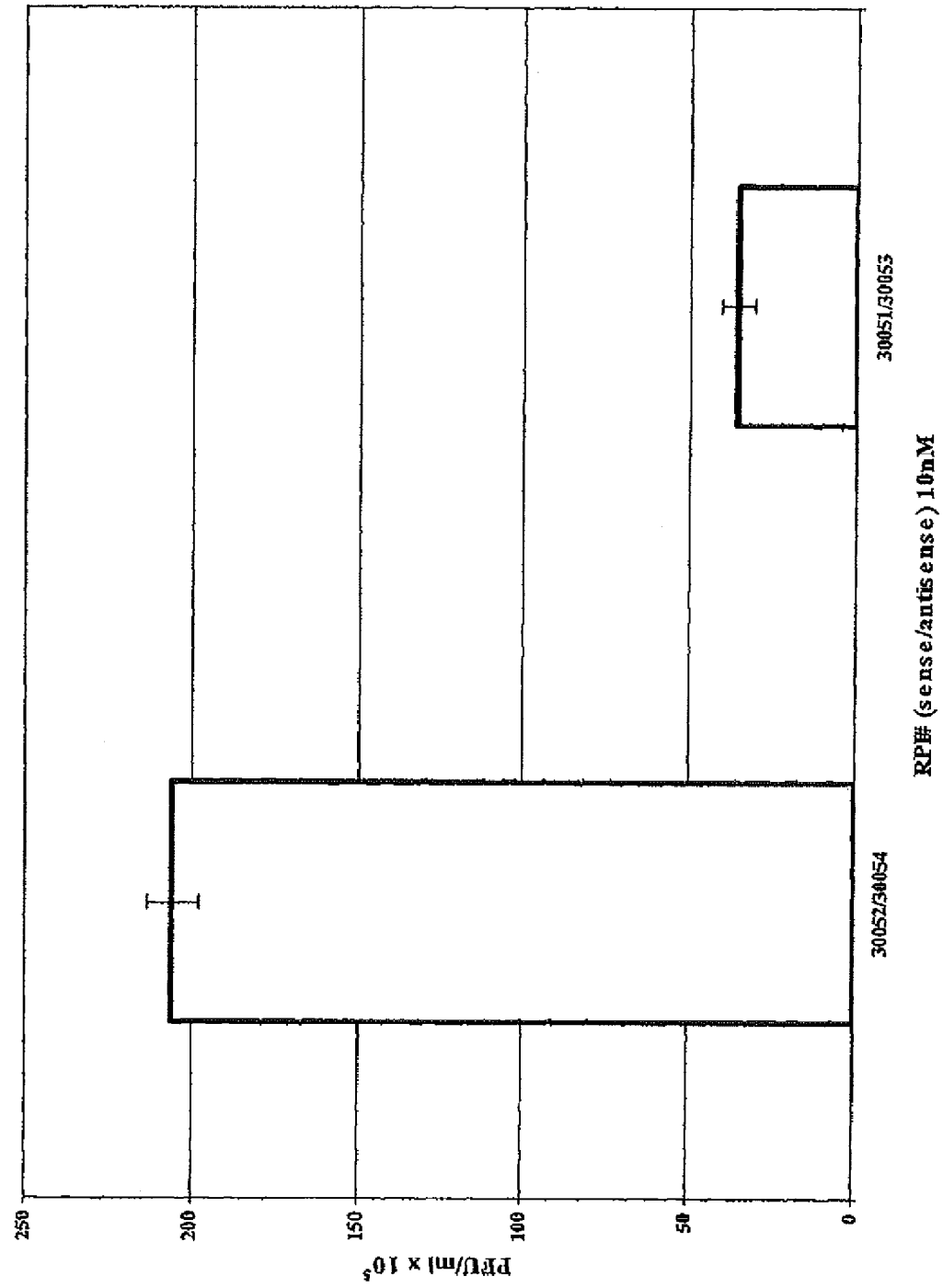
Figure 14: Chemically Modified siRNA targeting HCV chimera

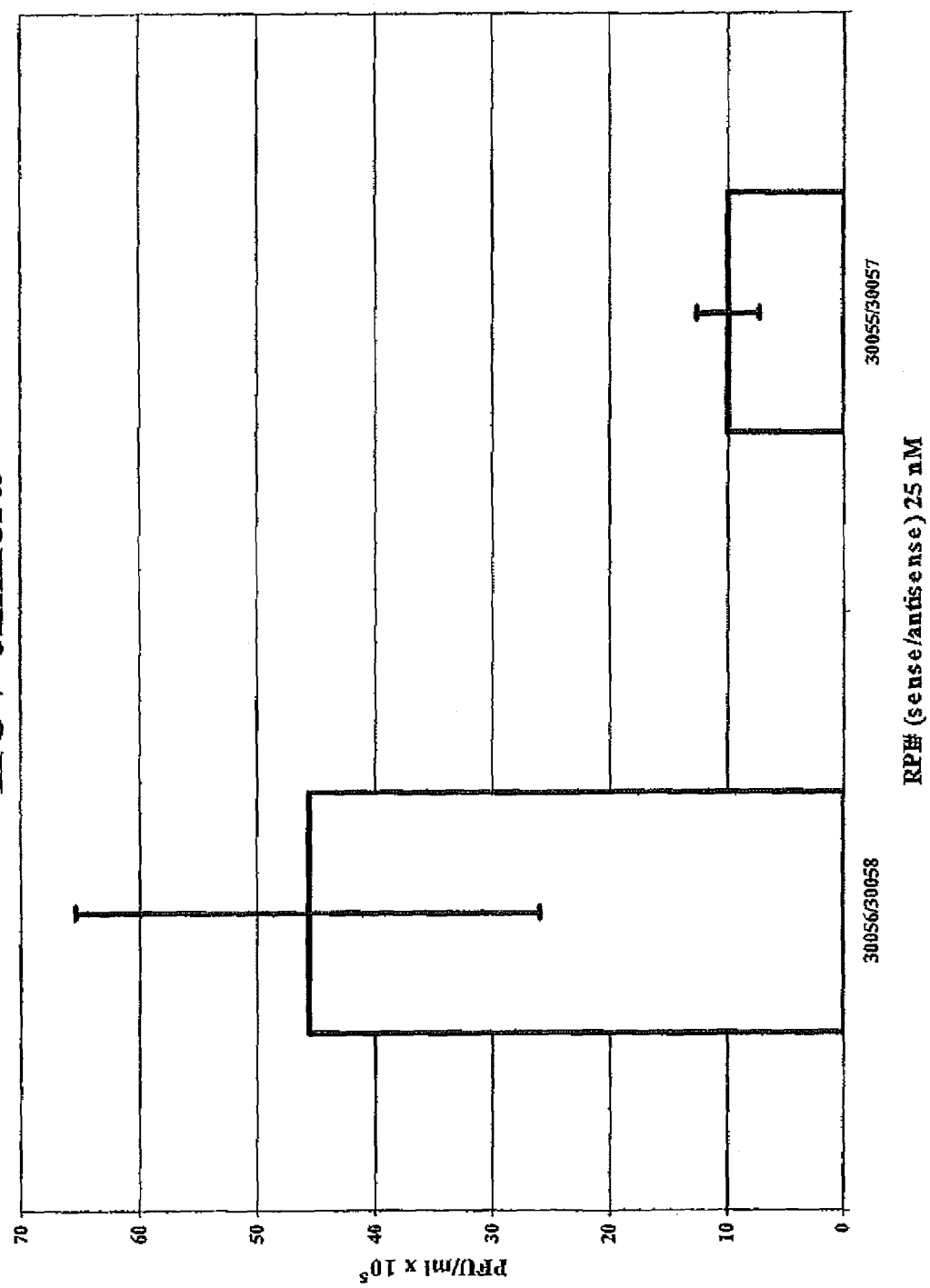
Figure 15: Chemically Modified siRNA targeting HCV chimera

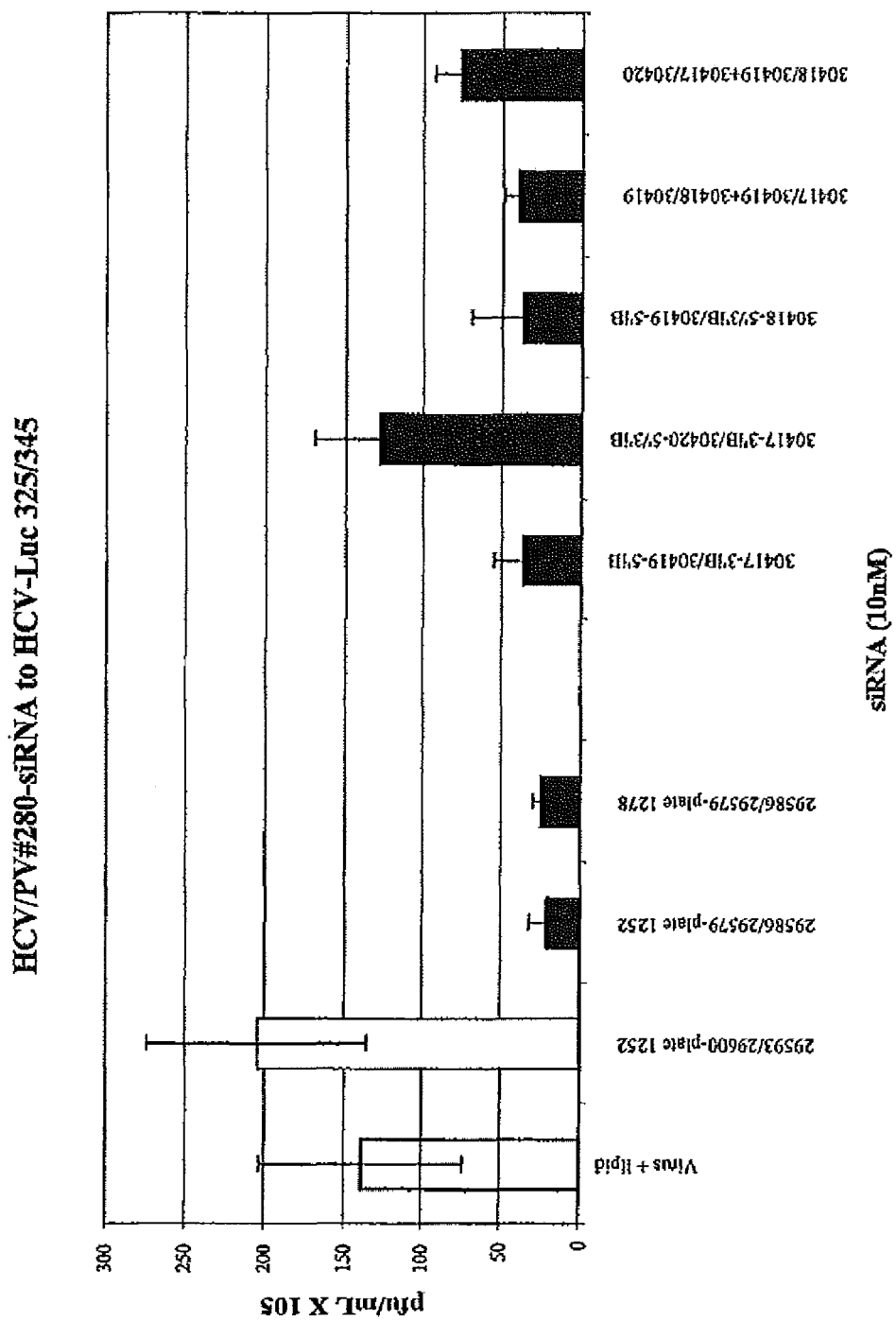
Figure 16: Chemically Modified siRNA targeting HCV chimera

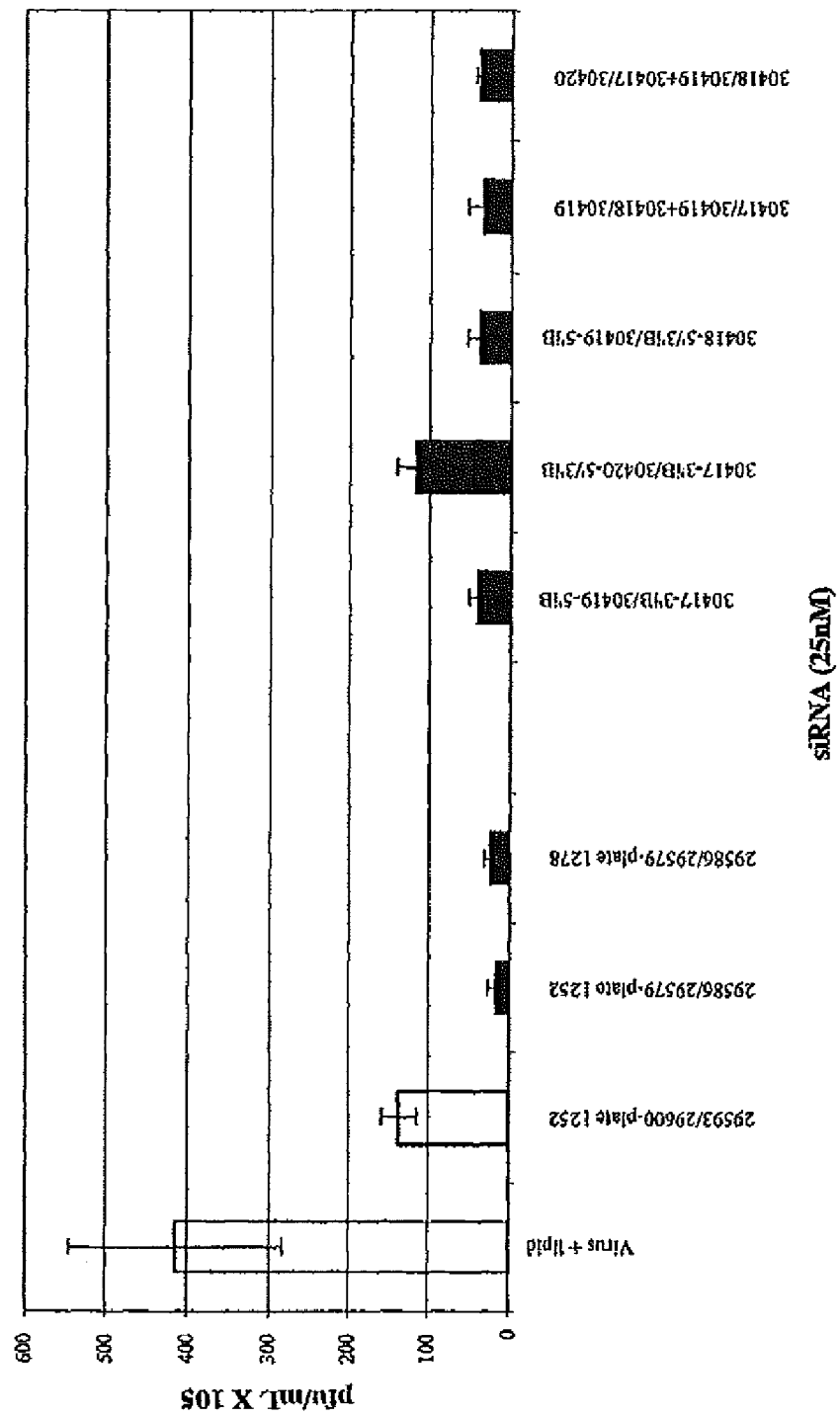
Figure 17: Chemically Modified siRNA targeting HCV chimera

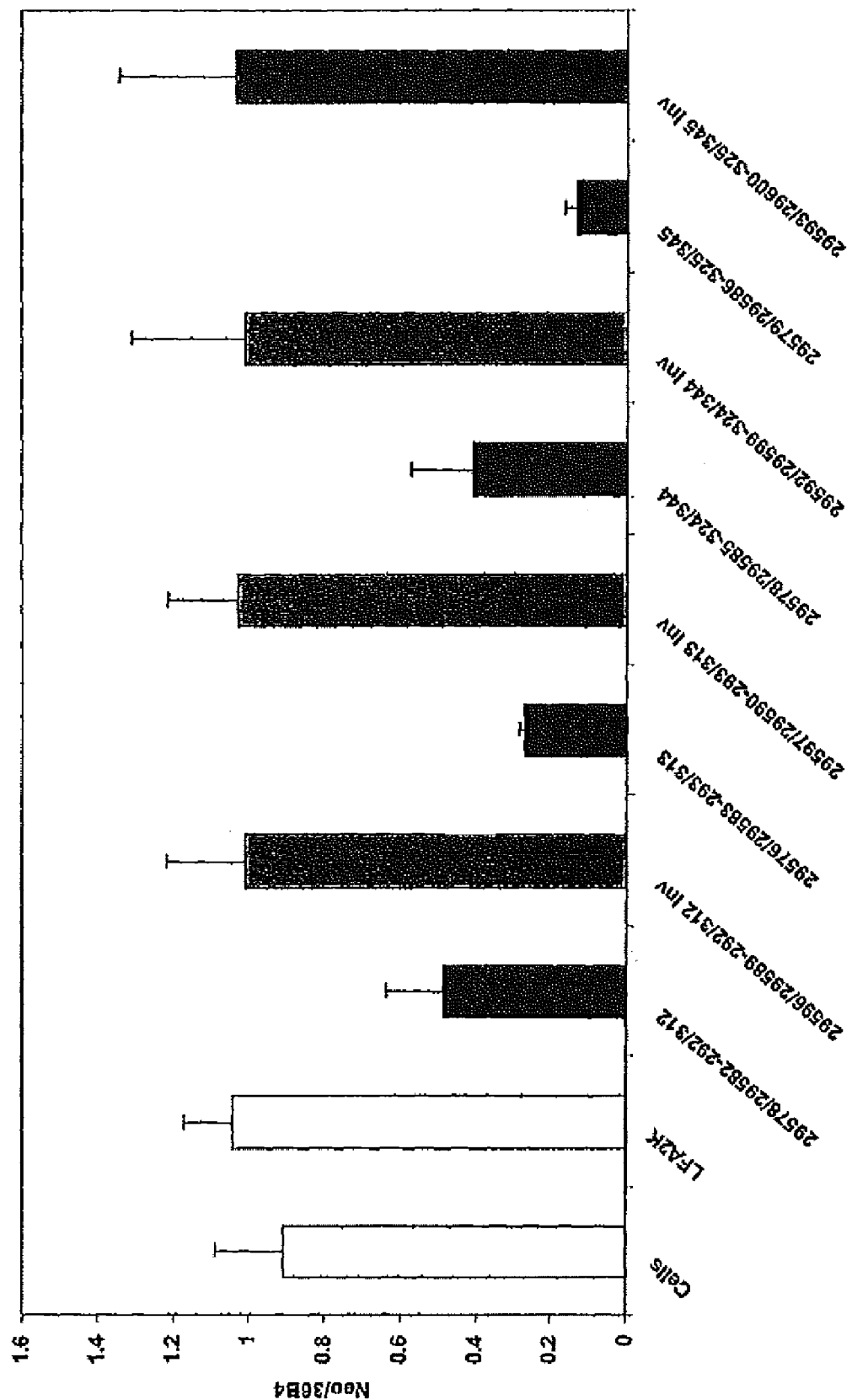
Figure 18: HCV/Replicon KJ#1-Clone A Cells transfected with 0.5μl/well LFA 2K-72 hours

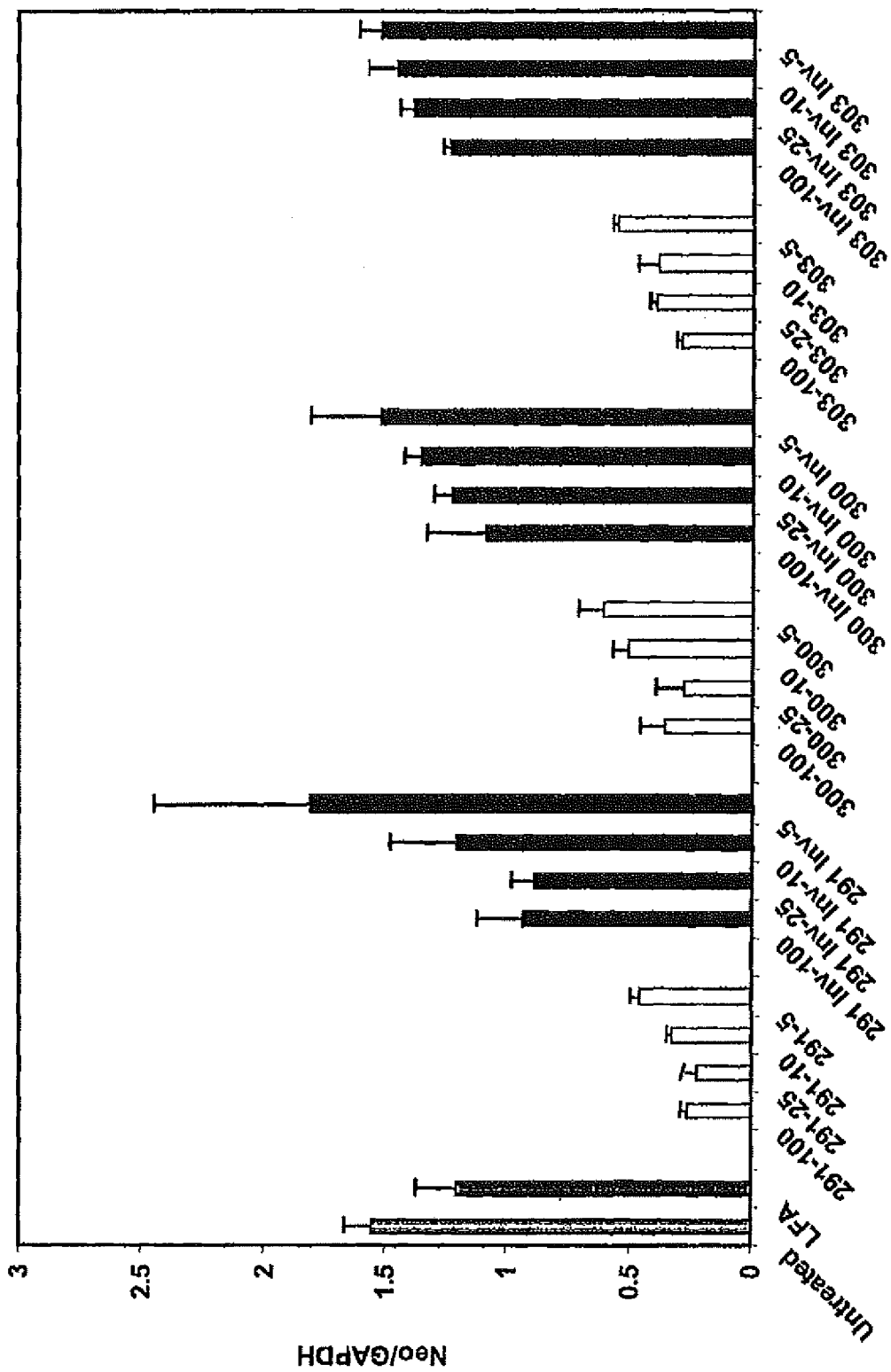
Figure 19: Dose Response with Stab4/5 siNA Leads in HCV Subgenomic Replicon

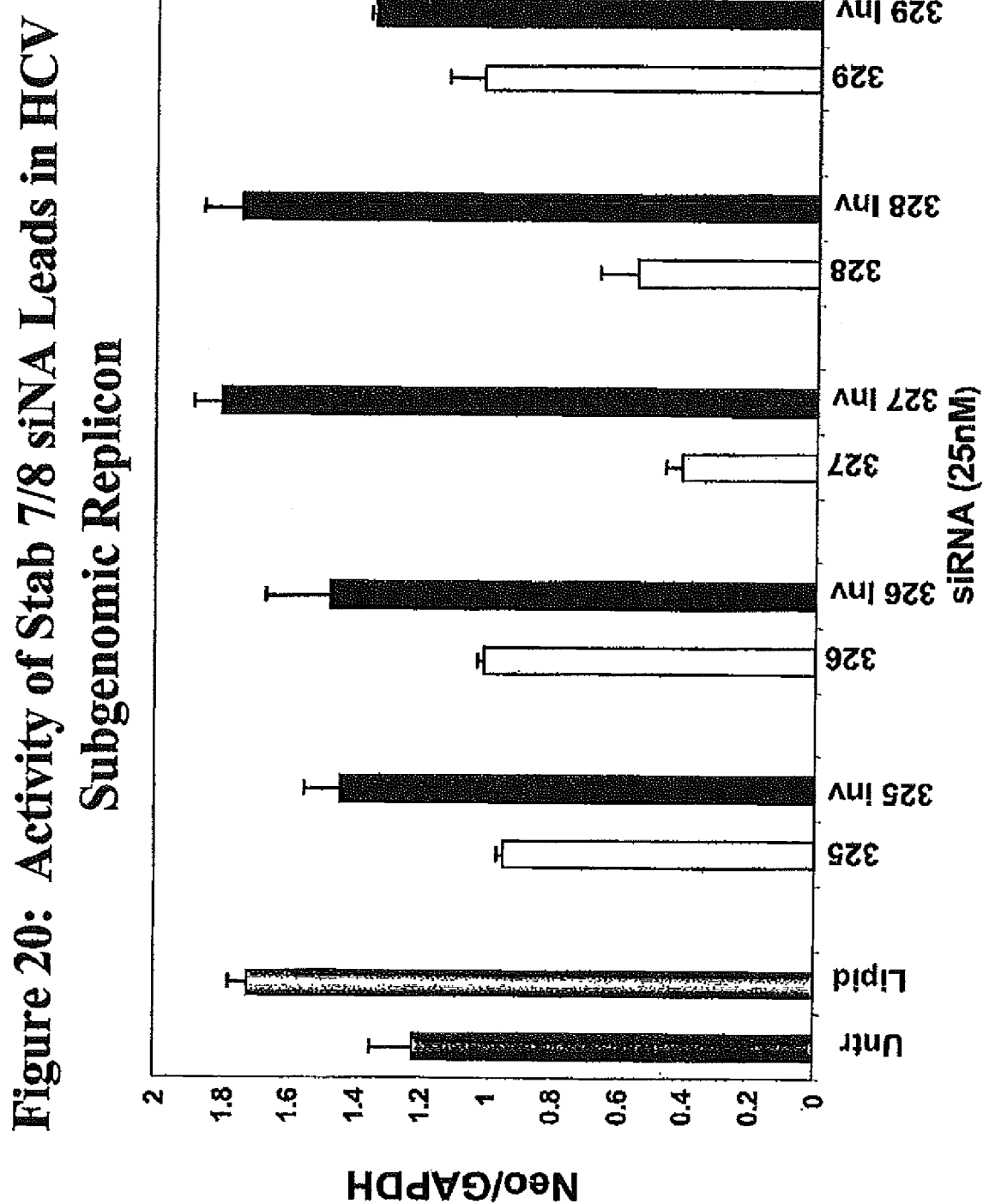
Figure 20: Activity of Stab 7/8 siNA Leads in HCV Subgenomic Replicon

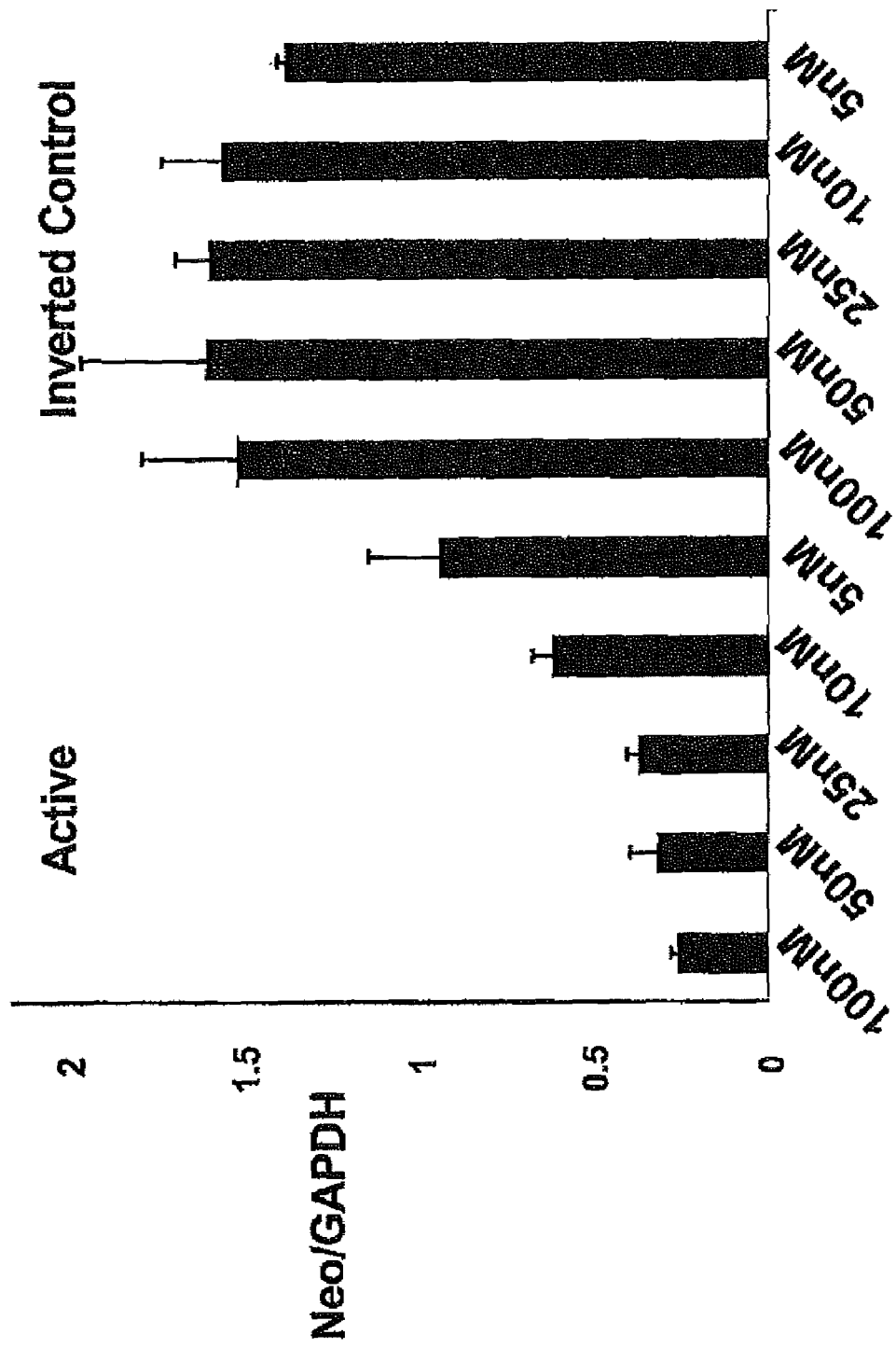
Figure 21: Dose Response with Fully Modified HCV Site 327 siNA

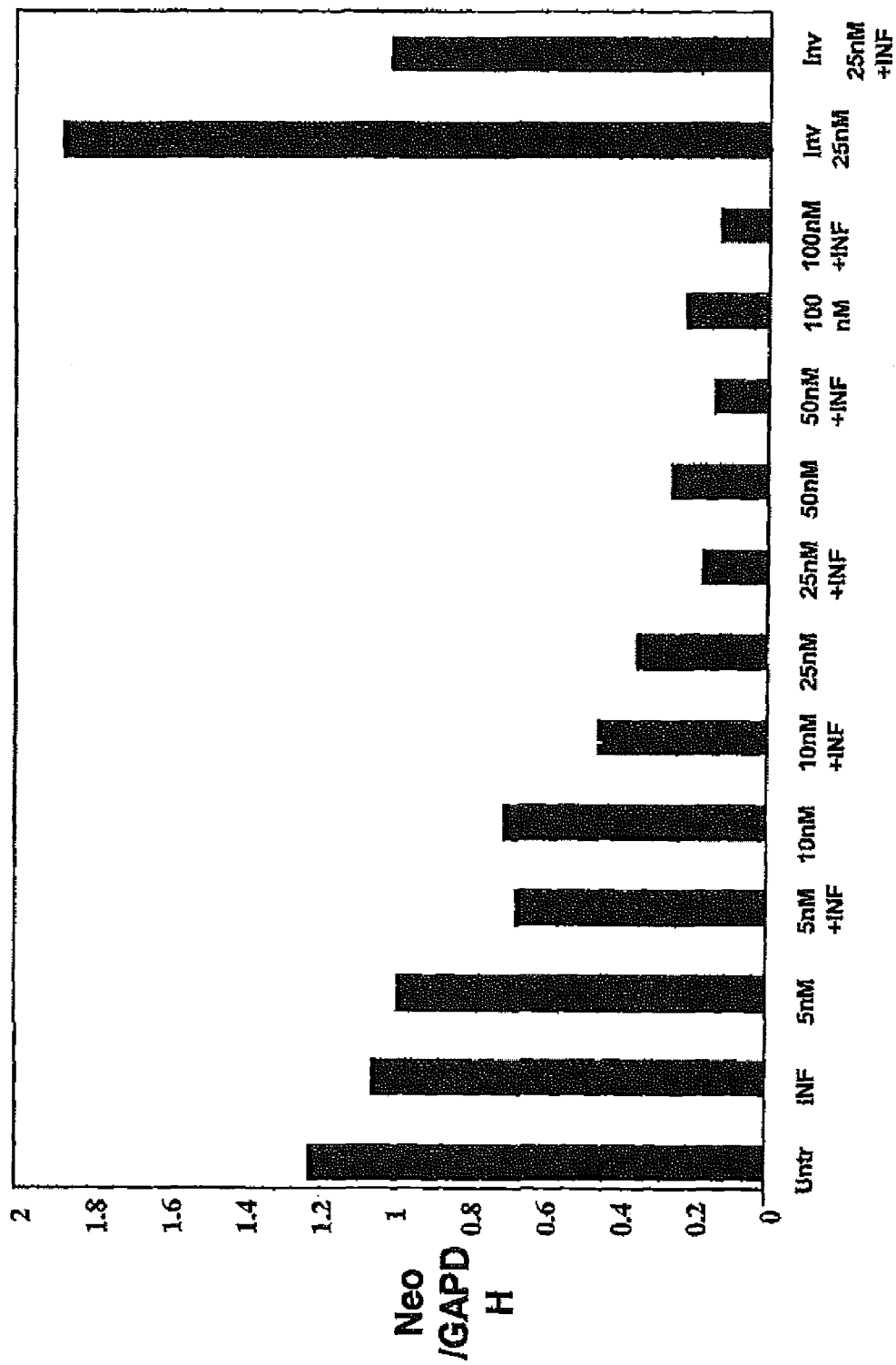
Figure 22: Activity of siNA/Interferon Combination Treatment in HCV Replicon

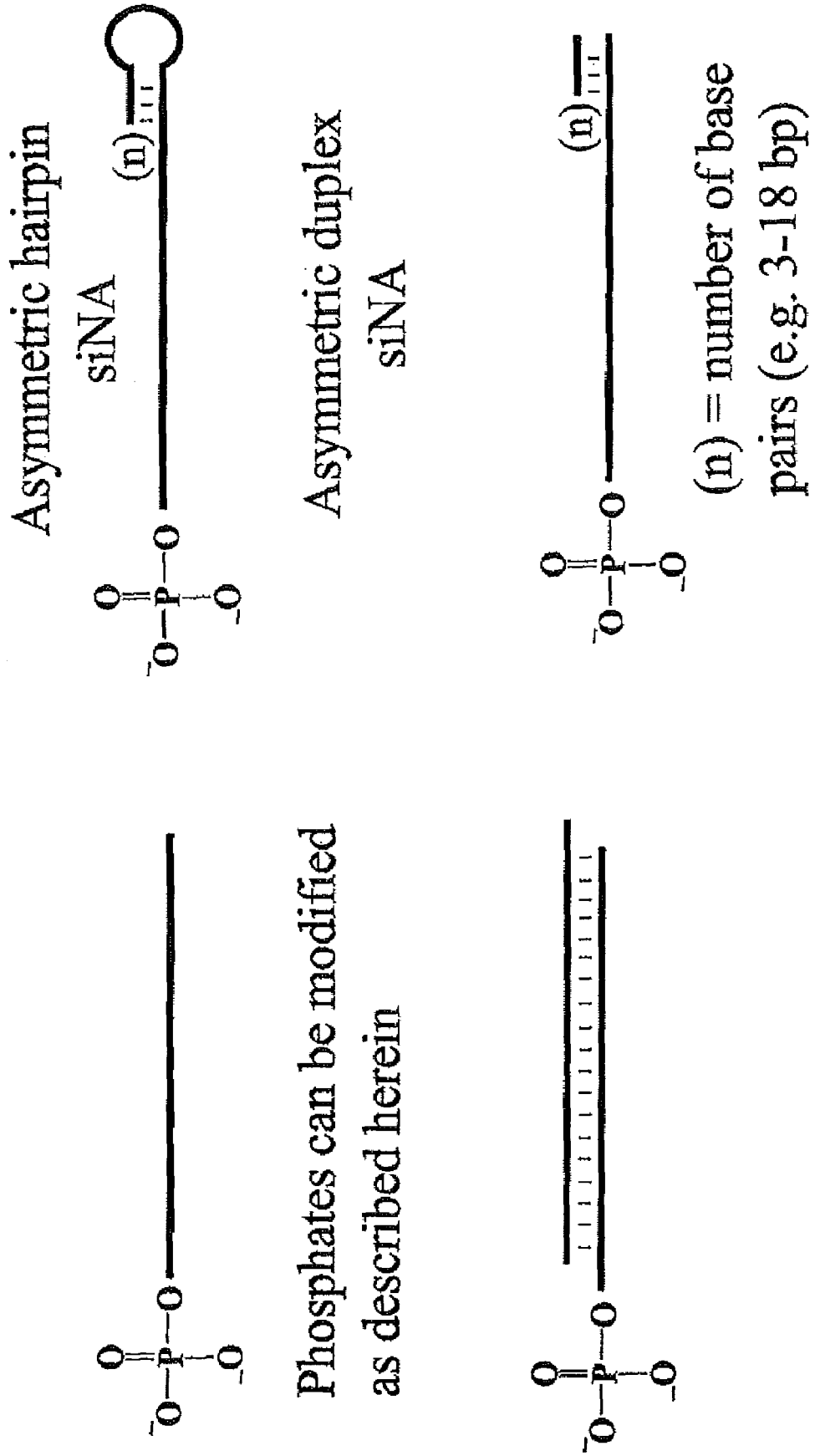

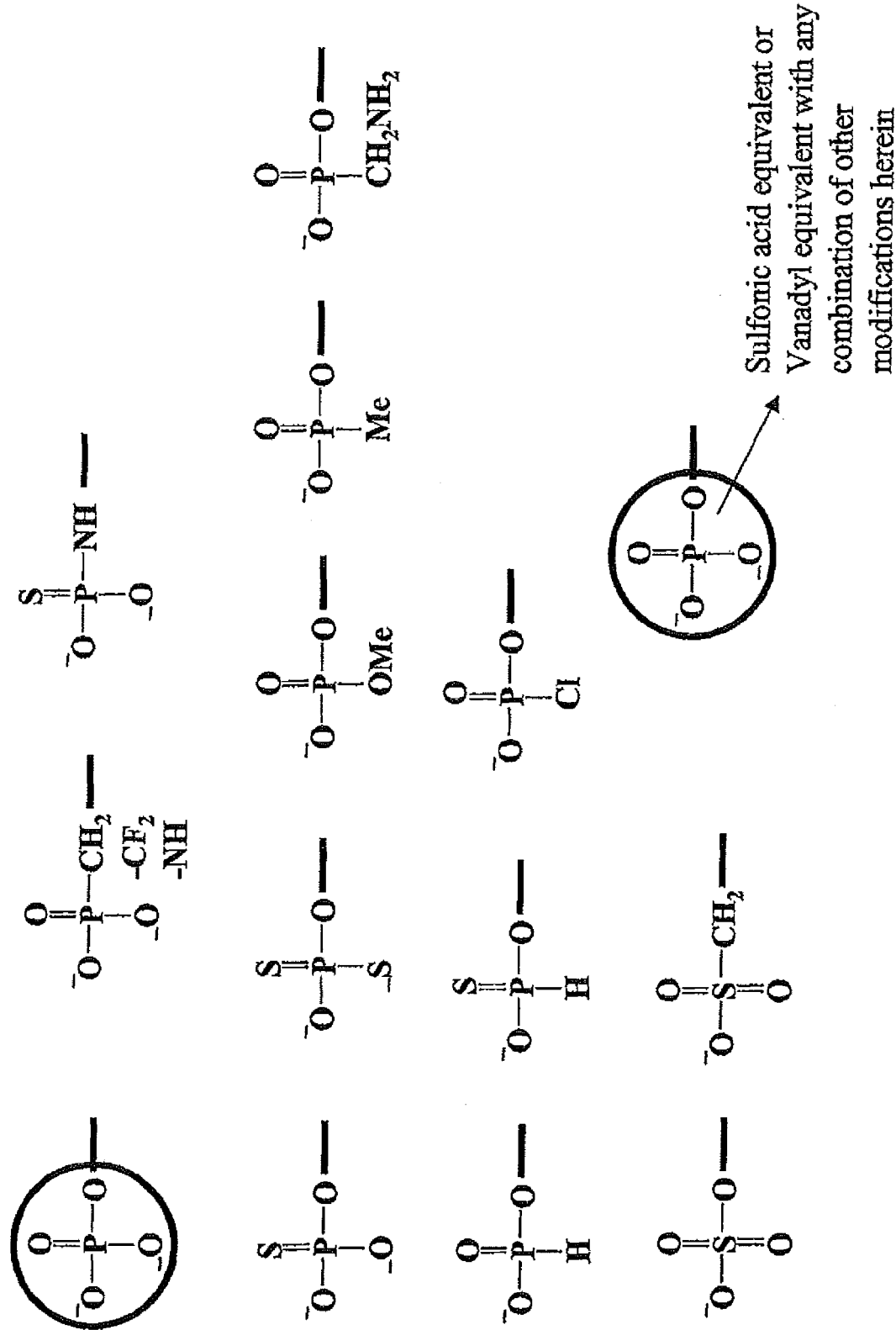
Figure 24: 5'-phosphate modifications

RNA INTERFERENCE MEDIATED INHIBITION OF HEPATITIS C VIRUS (HCV) GENE EXPRESSION USING SHORT INTERFERING NUCLEIC ACID (SINA)

This invention is a continuation of U.S. patent application Ser. No. 10/667,271, filed on Sep. 16, 2003, which is a continuation-in-part of U.S. patent application Ser. No. 10/444,853 filed May 23, 2003 and a continuation-in-part of International Patent Application No. PCT/US03/05043 filed Feb. 20, 2003, which is a continuation-in-part of International Patent Application No. PCT/US02/09187 filed Mar. 26, 2002, and claims the benefit of U.S. Provisional Application No. 60/401,104 filed Aug. 5, 2002, of U.S. Provisional Application No. 60/358,580 filed Feb. 20, 2002, of U.S. Provisional Application No. 60/363,124 filed Mar. 11, 2002, of U.S. Provisional Application No. 60/386,782 filed Jun. 6, 2002, of U.S. Provisional Application No. 60/406,784 filed Aug. 29, 2002, of U.S. Provisional Application No. 60/408,378 filed Sep. 5, 2002, of U.S. Provisional Application No. 60/409,293 filed Sep. 9, 2002, and of U.S. Provisional Application No. 60/440,129 filed Jan. 15, 2003. The instant application claims priority to all of the listed applications, which are hereby incorporated by reference herein in their entireties, including the drawings.

SEQUENCE LISTING

The sequence listing submitted via EFS, in compliance with 37 CFR §1.52(e)(5), is incorporated herein by reference. The sequence listing text file submitted via EFS contains the file "SequenceListingupdated39USCNT", created on Feb. 2, 2009 which is 507,076 bytes in size.

FIELD OF THE INVENTION

The present invention concerns compounds, compositions, and methods for the study, diagnosis, and treatment of conditions and diseases that respond to the modulation of hepatitis C virus (HCV) gene expression and/or activity. The present invention also concerns compounds, compositions, and methods relating to conditions and diseases that respond to the modulation of expression and/or activity of genes involved in HCV pathways. Specifically, the invention relates to double-stranded nucleic acids including small nucleic acid molecules, such as short interfering nucleic acid (siNA), short interfering RNA (siRNA), double-stranded RNA (dsRNA), micro-RNA (miRNA), and short hairpin RNA (shRNA) molecules capable of mediating RNA interference (RNAi) against hepatitis C virus (HCV) gene expression.

BACKGROUND OF THE INVENTION

The following is a discussion of relevant art pertaining to RNAi. The discussion is provided only for understanding of the invention that follows. The summary is not an admission that any of the work described below is prior art to the claimed invention.

RNA interference refers to the process of sequence-specific post-transcriptional gene silencing in animals mediated by short interfering RNAs (siRNAs) (Fire et al., 1998, Nature, 391, 806, Hamilton et al., 1999, Science, 286, 950-951). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., 1999, Trends Genet., 15, 358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA. The presence of dsRNA in cells triggers the RNAi response though a mechanism that has yet to be fully characterized. This mechanism appears to be different from the interferon response that results from dsRNA-mediated activation of protein kinase PKR and 2',5'-oligoadenylate synthetase resulting in non-specific cleavage of mRNA by ribonuclease L.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Hamilton et al., supra; Berstein et al., 2001, Nature, 409, 363). Short interfering RNAs derived from dicer activity are typically about 21 to about 23 nucleotides in length and comprise about 19 base pair duplexes (Hamilton et al., supra; Elbashir et al., 2001, Genes Dev., 15, 188). Dicer has also been implicated in the excision of 21- and 22-nucleotide small temporal RNAs (stRNAs) from precursor RNA of conserved structure that are implicated in translational control (Hutvagner et al., 2001, Science, 293, 834). The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex (Elbashir et al., 2001, Genes Dev., 15, 188).

RNAi has been studied in a variety of systems. Fire et al., 1998, Nature, 391, 806, were the first to observe RNAi in C. elegans. Bahramian and Zarbl, 1999, Molecular and Cellular Biology, 19, 274-283 and Wianny and Goetz, 1999, Nature Cell Biol., 2, 70, describe RNAi mediated by dsRNA in mammalian systems. Hammond et al., 2000, Nature, 404, 293, describe RNAi in Drosophila cells transfected with dsRNA. Elbashir et al., 2001, Nature, 411, 494, describe RNAi induced by introduction of duplexes of synthetic 21-nucleotide RNAs in cultured mammalian cells including human embryonic kidney and HeLa cells. Recent work in Drosophila embryonic lysates (Elbashir et al., 2001, EMBO J., 20, 6877) has revealed certain requirements for siRNA length, structure, chemical composition, and sequence that are essential to mediate efficient RNAi activity. These studies have shown that 21-nucleotide siRNA duplexes are most active when containing 3'-terminal dinucleotide overhangs. Furthermore, complete substitution of one or both siRNA strands with 2'-deoxy (2'-H) or 2'-O-methyl nucleotides abolishes RNAi activity, whereas substitution of the 3'-terminal siRNA overhang nucleotides with 2'-deoxy nucleotides (2'-H) was shown to be tolerated. Single mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end of the guide sequence (Elbashir et al., 2001, EMBO J., 20, 6877). Other studies have indicated that a 5'-phosphate on the target-complementary strand of an siRNA duplex is required for siRNA activity and that ATP is utilized to maintain the 5'-phosphate moiety on the siRNA (Nykanen et al., 2001, Cell, 107, 309).

Studies have shown that replacing the 3'-terminal nucleotide overhanging segments of a 21-mer siRNA duplex having two nucleotide 3'-overhangs with deoxyribonucleotides does not have an adverse effect on RNAi activity. Replacing up to four nucleotides on each end of the siRNA with deoxyribonucleotides has been reported to be well tolerated, whereas complete substitution with deoxyribonucleotides results in no RNAi activity (Elbashir et al., 2001, *EMBO J.*, 20, 6877). In addition, Elbashir et al., supra, also report that substitution of siRNA with 2'-O-methyl nucleotides completely abolishes RNAi activity. Li et al., International PCT Publication No. WO 00/44914, and Beach et al., International PCT Publication No. WO 01/68836 preliminarily suggest that siRNA may include modifications to either the phosphate-sugar backbone or the nucleoside to include at least one of a nitrogen or sulfur heteroatom, however, neither application postulates to what extent such modifications would be tolerated in siRNA molecules, nor provides any further guidance or examples of such modified siRNA. Kreutzer et al., Canadian Patent Application No. 2,359,180, also describe certain chemical modifications for use in dsRNA constructs in order to counteract activation of double-stranded RNA-dependent protein kinase PKR, specifically 2'-amino or 2'-O-methyl nucleotides, and nucleotides containing a 2'-O or 4'-C methylene bridge. However, Kreutzer et al. similarly fails to provide examples or guidance as to what extent these modifications would be tolerated in siRNA molecules.

Parrish et al., 2000, *Molecular Cell*, 6, 1977-1087, tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that RNAs with two phosphorothioate modified bases also had substantial decreases in effectiveness as RNAi. Further, Parrish et al. reported that phosphorothioate modification of more than two residues greatly destabilized the RNAs in vitro such that interference activities could not be assayed. Id. at 1081. The authors also tested certain modifications at the 2'-position of the nucleotide sugar in the long siRNA transcripts and found that substituting deoxynucleotides for ribonucleotides produced a substantial decrease in interference activity, especially in the case of Uridine to Thymidine and/or Cytidine to deoxy-Cytidine substitutions. Id. In addition, the authors tested certain base modifications, including substituting, in sense and antisense strands of the siRNA, 4-thiouracil, 5-bromouracil, 5-iodouracil, and 3-(aminoallyl)uracil for uracil, and inosine for guanosine. Whereas 4-thiouracil and 5-bromouracil substitution appeared to be tolerated, Parrish reported that inosine produced a substantial decrease in interference activity when incorporated in either strand. Parrish also reported that incorporation of 5-iodouracil and 3-(aminoallyl)uracil in the antisense strand resulted in a substantial decrease in RNAi activity as well.

The use of longer dsRNA has been described. For example, Beach et al., International PCT Publication No. WO 01/68836, describes specific methods for attenuating gene expression using endogenously-derived dsRNA. Tuschl et al., International PCT Publication No. WO 01/75164, describe a *Drosophila* in vitro RNAi system and the use of specific siRNA molecules for certain functional genomic and certain therapeutic applications; although Tuschl, 2001, *Chem. Biochem.*, 2, 239-245, doubts that RNAi can be used to cure genetic diseases or viral infection due to the danger of activating interferon response. Li et al., International PCT Publication No. WO 00/44914, describe the use of specific dsRNAs for attenuating the expression of certain target genes. Zernicka-Goetz et al., International PCT Publication No. WO 01/36646, describe certain methods for inhibiting the expression of particular genes in mammalian cells using certain dsRNA molecules. Fire et al., International PCT Publication No. WO 99/32619, describe particular methods for introducing certain dsRNA molecules into cells for use in inhibiting gene expression. Plaetinck et al., International PCT Publication No. WO 00/01846, describe certain methods for identifying specific genes responsible for conferring a particular phenotype in a cell using specific dsRNA molecules. Mello et al., International PCT Publication No. WO 01/29058, describe the identification of specific genes involved in dsRNA-mediated RNAi. Deschamps Depaillette et al., International PCT Publication No. WO 99/07409, describe specific compositions consisting of particular dsRNA molecules combined with certain anti-viral agents. Waterhouse et al., International PCT Publication No. 99/53050, describe certain methods for decreasing the phenotypic expression of a nucleic acid in plant cells using certain dsRNAs. Driscoll et al., International PCT Publication No. WO 01/49844, describe specific DNA constructs for use in facilitating gene silencing in targeted organisms.

Others have reported on various RNAi and gene-silencing systems. For example, Parrish et al., 2000, *Molecular Cell*, 6, 1977-1087, describe specific chemically modified siRNA constructs targeting the unc-22 gene of *C. elegans*. Grossniklaus, International PCT Publication No. WO 01/38551, describes certain methods for regulating polycomb gene expression in plants using certain dsRNAs. Churikov et al., International PCT Publication No. WO 01/42443, describe certain methods for modifying genetic characteristics of an organism using certain dsRNAs. Cogoni et al., International PCT Publication No. WO 01/53475, describe certain methods for isolating a *Neurospora* silencing gene and uses thereof. Reed et al., International PCT Publication No. WO 01/68836, describe certain methods for gene silencing in plants. Honer et al., International PCT Publication No. WO 01/70944, describe certain methods of drug screening using transgenic nematodes as Parkinson's disease models using certain dsRNAs. Deak et al., International PCT Publication No. WO 01/72774, describe certain *Drosophila*-derived gene products that may be related to RNAi in *Drosophila*. Arndt et al., International PCT Publication No. WO 01/92513 describe certain methods for mediating gene suppression by using factors that enhance RNAi. Tuschl et al., International PCT Publication No. WO 02/44321, describes certain synthetic siRNA constructs. Pachuk et al., International PCT Publication No. WO 00/63364, and Satishchandran et al., International PCT Publication No. WO 01/04313, describe certain methods and compositions for inhibiting the function of certain polynucleotide sequences using certain dsRNAs. Echeverri et al., International PCT Publication No. WO 02/38805, describe certain *C. elegans* genes identified via RNAi. Kreutzer et al., International PCT Publications Nos. WO 02/055692, WO 02/055693, and EP 1144623 B1 describe certain methods for inhibiting gene expression using RNAi. Graham et al., International PCT Publications Nos. WO 99/49029 and WO 01/70949, and AU 4037501 describe certain vector expressed siRNA molecules. Fire et al., U.S. Pat. No. 6,506,559, describe certain methods for inhibiting gene expression in vitro using certain long dsRNA (greater than 25 nucleotide) constructs that mediate RNAi. Harborth et al., 2003, Antisense & Nucleic Acid Drug Development, 13, 83-105, describe certain chemically and structurally modified siRNA molecules. Chiu and Rana, 2003, RNA, 9, 1034-1048, describe certain chemically and structurally modified siRNA molecules.

McCaffrey et al., 2002, *Nature,* 418, 38-39, describes the use of certain siRNA constructs targeting a chimeric HCV NS5B protein/luciferase transcript in mice.

Randall et al., 2003, *PNAS USA,* 100, 235-240, describe certain siRNA constructs targeting HCV RNA in Huh7 hepatoma cell lines.

SUMMARY OF THE INVENTION

This invention relates to compounds, compositions, and methods useful for modulating the expression of genes, such as those genes associated with the development or maintenance of HCV infection, liver failure, hepatocellular carcinoma, cirrhosis, and/or other disease states associated with HCV infection, by RNA interference (RNAi) using short interfering nucleic acid (siNA) molecules. This invention also relates to compounds, compositions, and methods useful for modulating the expression and activity of hepatitis C virus (HCV), or genes involved in hepatitis C virus (HCV) gene expression and/or activity by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of hepatitis C virus (HCV). An siNA of the invention can be unmodified or chemically modified. An siNA of the instant invention can be chemically synthesized, expressed from a vector or enzymatically synthesized. The instant invention also features various chemically modified synthetic short interfering nucleic acid (siNA) molecules capable of modulating hepatitis C virus gene expression or activity in cells by RNA interference (RNAi). The use of chemically modified siNA improves various properties of native siNA molecules through increased resistance to nuclease degradation in vivo and/or through improved cellular uptake. Further, contrary to earlier published studies, an siNA molecule having multiple chemical modifications retains its RNAi activity. The siNA molecules of the instant invention provide useful reagents and methods for a variety of therapeutic, diagnostic, target validation, genomic discovery, genetic engineering, and pharmacogenomic applications.

In one embodiment, the invention features one or more siNA molecules and methods that independently or in combination modulate the expression of gene(s) encoding the hepatitis C virus. Specifically, the present invention features siNA molecules that modulate the expression of HCV proteins, for example, proteins encoded by sequences shown as Genbank Accession Nos. in Table I.

In one embodiment, the invention features a double-stranded short interfering nucleic acid (siNA) molecule that down-regulates expression of an HCV RNA, wherein said siNA molecule comprises about 19 to about 21 base pairs.

In one embodiment, the invention features siNA molecules having RNAi specificity for the HCV minus strand, for example, Genbank Accession No. HPCK1S1, Hepatitis C virus (strain HCV-1b, clone HCV-K1-S1), complete genome; Genbank Accession No. D50483, 9410 nt.

In one embodiment, the invention features one or more siNA molecules and methods that independently or in combination modulate the expression of genes representing cellular targets for HCV infection, such as cellular receptors, cell surface molecules, cellular enzymes, cellular transcription factors, and/or cytokines, second messengers, and cellular accessory molecules including, but not limited to, interferon regulatory factors (IRFs; e.g., Genbank Accession No. AF082503.1); cellular PKR protein kinase (e.g., Genbank Accession No. XM_002661.7); human eukaryotic initiation factors 2B (elF2Bgamma; e.g., Genbank Accession No. AF256223, and/or elF2gamma; e.g., Genbank Accession No. NM_006874.1); human DEAD Box protein (DDX3; e.g., Genbank Accession No. XM_018021.2); and cellular proteins that bind to the poly(U) tract of the HCV 3'-UTR, such as polypyrimidine tract-binding protein (e.g., Genbank Accession Nos. NM_031991.1 and XM_042972.3).

Due to the high sequence variability of the HCV genome, selection of siNA molecules for broad therapeutic applications would likely involve the conserved regions of the HCV genome. In one embodiment, the present invention relates to siNA molecules that target the conserved regions of the HCV genome. Examples of conserved regions of the HCV genome include, but are not limited to, the 5'-Non Coding Region (NCR, also referred to as 5'-untranscribed region, UTR), the 5'-end of the core protein coding region, and the 3'-NCR. HCV genomic RNA contains an internal ribosome entry site (IRES) in the 5'-NCR which mediates translation independently of a 5'-cap structure (Wang et al., 1993, *J. Virol.,* 67, 3338-44). The full-length sequence of the HCV RNA genome is heterologous among clinically isolated subtypes, of which there are at least fifteen (Simmonds, 1995, *Hepatology,* 21, 570-583), however, the 5'-NCR sequence of HCV is highly conserved across all known subtypes, most likely to preserve the shared IRES mechanism (Okamoto et al., 1991, *J. General Virol.,* 72, 2697-2704). Therefore, an siNA molecule can be designed to target the different isolates of HCV by targeting a conserved region, such as the 5' NCR sequence. siNA molecules designed to target conserved regions of various HCV isolates enable efficient inhibition of HCV replication in diverse patient populations and ensure the effectiveness of the siNA molecules against HCV quasi species which evolve due to mutations in the non-conserved regions of the HCV genome. As described, a single siNA molecule can be targeted against all isolates of HCV by designing the siNA molecule to interact with conserved nucleotide sequences of HCV (e.g., sequences that are expected to be present in the RNA of various HCV isolates).

In one embodiment, the invention features one or more siNA molecules and methods that independently or in combination modulate the expression of gene(s) encoding HCV and/or cellular proteins associated with the maintenance or development of HCV infection, liver failure, hepatocellular carcinoma, and cirrhosis, such as genes encoding sequences comprising those sequences referred to by GenBank Accession Nos. shown in Table I, referred to herein generally as HCV. The description below of the various aspects and embodiments of the invention is provided with reference to exemplary hepatitis C virus (HCV) genes, generally referred to herein as HCV. However, such reference is meant to be exemplary only and the various aspects and embodiments of the invention are also directed to other genes that express alternate HCV genes, such as mutant HCV genes, splice variants of HCV genes, and genes encoding different strains of HCV, as well as cellular targets for HCV, such as those described herein. The various aspects and embodiments are also directed to other genes involved in HCV pathways, including genes that encode cellular proteins involved in the maintenance and/or development of HCV infection, liver failure, hepatocellular carcinoma, and cirrhosis or other genes that express other proteins associated with HCV infection, such as cellular proteins that are utilized in the HCV life-cycle. Such additional genes can be analyzed for target sites using the methods described herein for HCV. Thus, the inhibition and the effects of such inhibition of the other genes can be measured as described herein. In other words, the term "HCV" as it is defined herein below and recited in the described embodiments, is meant to encompass genes associated with the development and/or maintenance of HCV infection, such as genes which encode HCV polypeptides, including polypeptides of different strains of HCV, mutant HCV genes, and splice variants of HCV genes, as well as cellular genes involved in HCV pathways of gene expression, replication, and/or HCV activity. Also, the term "HCV" as it is defined herein and recited in the described embodiments, is meant to encompass HCV viral gene products and cellular gene products involved in HCV infection, such as those described herein. Thus, each of the embodiments described herein with reference to the term "HCV" are applicable to all of the virus, cellular and viral protein, peptide, polypeptide, and/or polynucleotide molecules covered by the term "HCV", as that term is defined herein.

In one embodiment, the invention features an siNA molecule that down-regulates expression of an HCV gene, for example, wherein the HCV gene comprises an HCV encoding sequence or a portion thereof.

In one embodiment, the invention features an siNA molecule having RNAi activity against HCV RNA, wherein the siNA molecule comprises a sequence complementary to any RNA having HCV encoding sequence, such as those sequences having HCV GenBank Accession Nos. shown in Table I. Chemical modifications as shown in Tables III and IV or otherwise described herein can be applied to any siNA construct of the invention.

In another embodiment, the invention features an siNA molecule having RNAi activity against an HCV gene, wherein the siNA molecule comprises nucleotide sequence complementary to a nucleotide sequence of an HCV gene, such as those HCV sequences having GenBank Accession Nos. shown in Table I. In another embodiment, an siNA molecule of the invention includes nucleotide sequence that can interact with nucleotide sequence of an HCV gene and thereby mediate silencing of HCV gene expression, for example, wherein the siNA mediates regulation of HCV gene expression by cellular processes that modulate the chromatin structure of the HCV gene and prevent transcription of the HCV gene.

In another embodiment, the invention features an siNA molecule comprising a nucleotide sequence, for example, a nucleotide sequence in the antisense region of the siNA molecule that is complementary to a nucleotide sequence of an HCV gene or portion thereof. In another embodiment, the invention features an siNA molecule comprising a region, for example, the antisense region of the siNA construct, complementary to a sequence comprising an HCV gene sequence or portion thereof.

In one embodiment, the antisense region of HCV siNA constructs can comprise a sequence complementary to sequence having any of SEQ ID NOs. 1-696, 1393-1413, or 1606-1612. In one embodiment, the antisense region can also comprise a sequence having any of SEQ ID NOs. 697-1392, 1414, 1418, 1420, 1428-1434, 1456-1462, 1479, 1483, 1489-1491, 1493, 1497-1498, 1633-1636, 1658-1681, 1698, 1700, 1702, or 1705. In another embodiment, the sense region of HCV constructs can comprise a sequence having any of SEQ ID NOs. 1-696, 1393-1411, 1606-1612, 1413, 1417, 1419, 1421-1427, 1449-1455, 1477-1478, 1481-1482, 1485-1488, 1494-1496, 1499, 1501-1512, 1549, 1553, 1558-1569, 1613-1616, 1629-1632, 1645-1647, 1651, 1653, 1655-1657, 1658-1681, 1697, 1699, 1701, 1703, or 1704. The sense region can comprise a sequence of SEQ ID NO. 1688 and the antisense region can comprise a sequence of SEQ ID NO. 1689. The sense region can comprise a sequence of SEQ ID NO. 1690 and the antisense region can comprise a sequence of SEQ ID NO. 1691. The sense region can comprise a sequence of SEQ ID NO. 1692 and the antisense region can comprise a sequence of SEQ ID NO. 1693. The sense region can comprise a sequence of SEQ ID NO. 1694 and the antisense region can comprise a sequence of SEQ ID NO. 1691. The sense region can comprise a sequence of SEQ ID NO. 1695 and the antisense region can comprise a sequence of SEQ ID NO. 1691. The sense region can comprise a sequence of SEQ ID NO. 1694 and the antisense region can comprise a sequence of SEQ ID NO. 1696.

In one embodiment, an siNA molecule of the invention comprises any of SEQ ID NOs. 1-1681 or 1688-1705. The sequences shown in SEQ ID NOs: 1-1681 and 1688-1705 are not limiting. An siNA molecule of the invention can comprise any contiguous HCV sequence (e.g., about 19 to about 25, or in other words about 19, 20, 21, 22, 23, 24 or 25 contiguous HCV nucleotides).

In yet another embodiment, the invention features an siNA molecule comprising a sequence, for example, the antisense sequence of the siNA construct, complementary to a sequence or portion of a sequence comprising a sequence represented by GenBank Accession Nos. shown in Table I. Chemical modifications in Tables III and IV and described herein can be applied to any siRNA construct of the invention.

In one embodiment of the invention an siNA molecule comprises an antisense strand having about 19 to about 29 nucleotides (e.g., about 19, 20, 21, 22, 23, 24, 25, 26, 27, 28, or 29), wherein the antisense strand is complementary to a RNA sequence encoding an HCV protein, and further comprises a sense strand having about 19 to about 29 (e.g., about 19, 20, 21, 22, 23, 24, 25, 26, 27, 28 or 29) nucleotides, wherein the sense strand and the antisense strand are distinct nucleotide sequences with at least about 19 complementary nucleotides.

In another embodiment of the invention an siNA molecule of the invention comprises an antisense region having about 19 to about 29 (e.g., about 19, 20, 21, 22, 23, 24, 25, 26, 27, 28 or 29) nucleotides, wherein the antisense region is complementary to a RNA sequence encoding an HCV protein, and further comprises a sense region having about 19 to about 29 nucleotides (e.g., about 19, 20, 21, 22, 23, 24, 25, 26, 27, 28, or 29), wherein the sense region and the antisense region comprise a linear molecule with at least about 19 complementary nucleotides.

In one embodiment of the invention an siNA molecule comprises an antisense strand comprising a nucleotide sequence that is complementary to a nucleotide sequence encoding an HCV protein or a portion thereof. The siNA further comprises a sense strand, wherein the sense strand comprises a nucleotide sequence of an HCV gene or a portion thereof.

In one embodiment, an siNA molecule of the invention has RNAi activity that modulates expression of RNA encoded by an HCV gene. Because HCV genes can share some degree of sequence homology with each other, siNA molecules can be designed to target a class of HCV genes or alternately, specific HCV genes, by selecting sequences that are either shared amongst different HCV targets or alternatively that are unique for a specific HCV target. Therefore, in one embodiment, the siNA molecule can be designed to target conserved regions of an HCV RNA sequence having homology between several HCV genes so as to target several HCV genes (e.g., different HCV isoforms, splice variants, mutant genes etc.) with one siNA molecule. In another embodiment, the siNA molecule can be designed to target a sequence that is unique to a specific HCV RNA sequence due to the high degree of specificity that the siNA molecule requires to mediate RNAi activity.

In one embodiment, nucleic acid molecules of the invention that act as mediators of the RNA interference gene silencing response are double-stranded nucleic acid molecules. In another embodiment, the siNA molecules of the invention consist of duplexes containing about 19 base pairs between oligonucleotides comprising about 19 to about 25 (e.g., about 19, 20, 21, 22, 23, 24 or 25) nucleotides. In yet another embodiment, siNA molecules of the invention comprise duplexes with overhanging ends of about 1 to about 3 (e.g., about 1, 2, or 3) nucleotides, for example about 21-nucleotide duplexes with about 19 base pairs and 3'-terminal mononucleotide, dinucleotide, or trinucleotide overhangs.

In one embodiment, the invention features one or more chemically modified siNA constructs having specificity for HCV expressing nucleic acid molecules, such as RNA encoding an HCV protein. Non-limiting examples of such chemical modifications include without limitation phosphorothioate internucleotide linkages, 2'-deoxyribonucleotides, 2'-O-methyl ribonucleotides, 2'-deoxy-2'-fluoro ribonucleotides, "universal base" nucleotides, "acyclic" nucleotides, 5-C-methyl nucleotides, and terminal glyceryl and/or inverted deoxy abasic residue incorporation. These chemical modifications, when used in various siNA constructs, are shown to preserve RNAi activity in cells while at the same time, dramatically increasing the serum stability of these compounds. Furthermore, contrary to the data published by Parrish et al., supra, applicant demonstrates that multiple (greater than one) phosphorothioate substitutions are well-tolerated and confer substantial increases in serum stability for modified siNA constructs.

In one embodiment, an siNA molecule of the invention comprises modified nucleotides while maintaining the ability to mediate RNAi. The modified nucleotides can be used to improve in vitro or in vivo characteristics such as stability, activity, and/or bioavailability. For example, an siNA molecule of the invention can comprise modified nucleotides as a percentage of the total number of nucleotides present in the siNA molecule. As such, an siNA molecule of the invention can generally comprise about 5% to about 100% modified nucleotides (e.g., 5%, 10%, 15%, 20%, 25%, 30%, 35%, 40%, 45%, 50%, 55%, 60%, 65%, 70%, 75%, 80%, 85%, 90%, 95% or 100% modified nucleotides). The actual percentage of modified nucleotides present in a given siNA molecule will depend on the total number of nucleotides present in the siNA. If the siNA molecule is single stranded, the percent modification can be based upon the total number of nucleotides present in the single stranded siNA molecules. Likewise, if the siNA molecule is double-stranded, the percent modification can be based upon the total number of nucleotides present in the sense strand, antisense strand, or both the sense and antisense strands.

In one embodiment, the invention features a double-stranded short interfering nucleic acid (siNA) molecule that inhibits replication of a hepatitis C virus (HCV), wherein one of the strands of the double-stranded siNA molecule is an antisense strand, which comprises a nucleotide sequence that is complementary to the nucleotide sequence of an HCV RNA or a portion thereof and the other strand is a sense strand, which comprises a nucleotide sequence that is complementary to the nucleotide sequence of the antisense strand. In one embodiment, the HCV RNA comprises HCV minus strand RNA. In another embodiment, the HCV RNA comprises HCV plus strand RNA.

In one embodiment, the invention features a double-stranded short interfering nucleic acid (siNA) molecule that inhibits replication of a hepatitis C virus (HCV), wherein one of the strands of the double-stranded siNA molecule is an antisense strand, which comprises a nucleotide sequence that is complementary to the nucleotide sequence of an HCV RNA or a portion thereof, and the other strand is a sense strand, which comprises a nucleotide sequence that is complementary to the nucleotide sequence of the antisense strand, wherein a majority of the pyrimidine nucleotides present in the double-stranded siNA molecule comprises a sugar modification. In one embodiment, all of the pyrimidine nucleotides present in the double-stranded siNA molecule comprise a sugar modification. In one embodiment, each strand of the double-stranded siNA molecule comprises about 19 to about 29 nucleotides and each strand comprises at least about 19 nucleotides that are complementary to the nucleotides of the other strand. In another embodiment, the double-stranded siNA molecule is assembled from two oligonucleotide fragments, wherein one fragment comprises nucleotide sequence of the antisense strand of the siNA molecule and the second fragment comprises nucleotide sequence of the sense strand of the siNA molecule. In yet another embodiment, the sense strand of the double-stranded siNA molecule is connected to the antisense strand via a linker molecule, such as a polynucleotide linker or a non-nucleotide linker. In another embodiment, any pyrimidine nucleotides (i.e., one or more or all) present in the sense strand of the double-stranded siNA molecule are 2'-deoxy-2'-fluoro pyrimidine nucleotides and any purine nucleotides (i.e., one or more or all) present in the sense region are 2'-deoxy purine nucleotides. In yet another embodiment, the sense strand of the double-stranded siNA molecule comprises a 3'-end and a 5'-end, wherein a terminal cap moiety (e.g., an inverted deoxy abasic moiety or inverted deoxy nucleotide moiety such as inverted thymidine) is present at the 5'-end, the 3'-end, or both of the 5' and 3' ends of the sense strand. In another embodiment, the antisense strand of the double-stranded siNA molecule comprises one or more 2'-deoxy-2'-fluoro pyrimidine nucleotides and one or more 2'-O-methyl purine nucleotides. In yet another embodiment, any pyrimidine nucleotides present in the antisense strand of the double-stranded siNA molecule are 2'-deoxy-2'-fluoro pyrimidine nucleotides and any purine nucleotides present in the antisense strand are 2'-O-methyl purine nucleotides. In another embodiment, the antisense strand of the double-stranded siNA molecule comprises a phosphorothioate internucleotide linkage at the 3' end of the antisense strand. In yet another embodiment, the antisense strand comprises a glyceryl modification at the 3' end of the antisense strand. In still another embodiment, the 5'-end of the antisense strand optionally includes a phosphate group.

In one embodiment, the invention features a double-stranded short interfering nucleic acid (siNA) molecule that inhibits replication of a hepatitis C virus (HCV), wherein one of the strands of the double-stranded siNA molecule is an antisense strand which comprises a nucleotide sequence that is complementary to the nucleotide sequence of an HCV RNA or a portion thereof and the other strand is a sense strand which comprises a nucleotide sequence that is complementary to the nucleotide sequence of the antisense strand, wherein a majority of the pyrimidine nucleotides present in the double-stranded siNA molecule comprises a sugar modification, and wherein each of the two strands of said siNA molecule comprises 21 nucleotides. In one embodiment, 21 nucleotides of the antisense strand are base-paired to the nucleotide sequence of the HCV RNA or a portion thereof. In another embodiment, about 19 nucleotides of the antisense strand are base-paired to the nucleotide sequence of the HCV RNA or a portion thereof. In one embodiment, each strand of the siNA molecule is base-paired to the complementary nucleotides of the other strand of the siNA molecule. In another embodiment, about 19 nucleotides of each strand of the siNA molecule are base-paired to the complementary nucleotides of the other strand of the siNA molecule and at least two 3' terminal nucleotides of each strand of the siNA molecule are not base-paired to the nucleotides of the other strand of the siNA molecule. In one embodiment, each of the two 3' terminal nucleotides of each strand of the siNA molecule that are not base-paired are 2'-deoxy-pyrimidines, such as 2'-deoxy-thymidine.

In one embodiment, the invention features a double-stranded short interfering nucleic acid (siNA) molecule that inhibits replication of a hepatitis C virus (HCV), wherein one of the strands of the double-stranded siNA molecule is an antisense strand which comprises a nucleotide sequence that is complementary to the nucleotide sequence of an HCV RNA or a portion thereof and the other strand is a sense strand which comprises a nucleotide sequence that is complementary to the nucleotide sequence of the antisense strand, wherein a majority of the pyrimidine nucleotides present in the double-stranded siNA molecule comprises a sugar modification and wherein the nucleotide sequence of the antisense strand or a portion thereof is complementary to a nucleotide sequence of the 5'-untranslated region of an HCV RNA or a portion thereof.

In another embodiment, the invention features a double-stranded short interfering nucleic acid (siNA) molecule that inhibits replication of a hepatitis C virus (HCV), wherein one of the strands of the double-stranded siNA molecule is an antisense strand which comprises a nucleotide sequence that is complementary to the nucleotide sequence of an HCV RNA or a portion thereof, and the other strand is a sense strand which comprises a nucleotide sequence that is complementary to the nucleotide sequence of the antisense strand, wherein a majority of the pyrimidine nucleotides present in the double-stranded siNA molecule comprises a sugar modification and wherein the nucleotide sequence of the antisense strand or a portion thereof is complementary to a nucleotide sequence of an HCV RNA that is present in the RNA of all HCV.

In one embodiment, the invention features a double-stranded short interfering nucleic acid (siNA) molecule that down-regulates expression of an HCV RNA comprising a sense region and an antisense region, wherein the antisense region comprises a nucleotide sequence that is complementary to a nucleotide sequence of HCV RNA or a portion thereof and the sense region comprises a nucleotide sequence that is complementary to the antisense region, and wherein the siNA molecule has one or more modified pyrimidine and/or purine nucleotides. In one embodiment, the pyrimidine nucleotides in the sense region are 2'-O-methylpyrimidine nucleotides or 2'-deoxy-2'-fluoro pyrimidine nucleotides and the purine nucleotides present in the sense region are 2'-deoxy purine nucleotides. In another embodiment, the pyrimidine nucleotides in the sense region are 2'-deoxy-2'-fluoro pyrimidine nucleotides and the purine nucleotides present in the sense region are 2'-O-methyl purine nucleotides. In another embodiment, the pyrimidine nucleotides in the sense region are 2'-deoxy-2'-fluoro pyrimidine nucleotides and the purine nucleotides present in the sense region are 2'-deoxy purine nucleotides. In one embodiment, the pyrimidine nucleotides in the antisense region are 2'-deoxy-2'-fluoro pyrimidine nucleotides and the purine nucleotides present in the antisense region are 2'-O-methyl or 2'-deoxy purine nucleotides. In another embodiment of any of the above described siNA molecules, any nucleotides present in a non-complementary region of the sense strand (e.g. overhang region) are 2'-deoxy nucleotides.

In one embodiment, the invention features a double-stranded short interfering nucleic acid (siNA) molecule that inhibits replication of a hepatitis C virus (HCV), wherein one of the strands of the double-stranded siNA molecule is an antisense strand which comprises nucleotide sequence that is complementary to the nucleotide sequence of an RNA encoding an HCV protein or a fragment thereof and the other strand is a sense strand which comprises a nucleotide sequence that is complementary to the nucleotide sequence of the antisense strand. In one embodiment, a majority of the pyrimidine nucleotides present in the double-stranded siNA molecule comprises a sugar modification.

In one embodiment, the invention features a double-stranded short interfering nucleic acid (siNA) molecule that inhibits replication of a hepatitis C virus (HCV), wherein the siNA molecule is assembled from two separate oligonucleotide fragments wherein one fragment comprises the sense region and the second fragment comprises the antisense region of the siNA molecule, and wherein the fragment comprising the sense region includes a terminal cap moiety at the 5'-end, the 3'-end, or both of the 5' and 3' ends of the fragment comprising the sense region. In another embodiment, the terminal cap moiety is an inverted deoxy abasic moiety or glyceryl moiety. In another embodiment, each of the two fragments of the siNA molecule comprise about 21 nucleotides.

In one embodiment, the invention features an siNA molecule comprising at least one modified nucleotide, wherein the modified nucleotide is a 2'-deoxy-2'-fluoro nucleotide. The siNA can be, for example, of length between about 12 and about 36 nucleotides. In another embodiment, all pyrimidine nucleotides present in the siNA are 2'-deoxy-2'-fluoro pyrimidine nucleotides. In another embodiment, the modified nucleotides in the siNA include at least one 2'-deoxy-2'-fluoro cytidine or 2'-deoxy-2'-fluoro uridine nucleotide. In another embodiment, the modified nucleotides in the siNA include at least one 2'-deoxy-2'-fluoro cytidine and at least one 2'-deoxy-2'-fluoro uridine nucleotides. In another embodiment, all uridine nucleotides present in the siNA are 2'-deoxy-2'-fluoro uridine nucleotides. In another embodiment, all cytidine nucleotides present in the siNA are 2'-deoxy-2'-fluoro cytidine nucleotides. In another embodiment, all adenosine nucleotides present in the siNA are 2'-deoxy-2'-fluoro adenosine nucleotides. In another embodiment, all guanosine nucleotides present in the siNA are 2'-deoxy-2'-fluoro guanosine nucleotides. The siNA can further comprise at least one modified internucleotidic linkage, such as phosphorothioate linkage. In another embodiment, the 2'-deoxy-2'-fluoronucleotides are present at specifically selected locations in the siNA that are sensitive to cleavage by ribonucleases, such as locations having pyrimidine nucleotides. In another embodiment, the siNA comprises a sequence that is complementary to a nucleotide sequence in a separate RNA, such as a viral RNA (e.g., HCV RNA).

In one embodiment, the invention features a method of increasing the stability of an siNA molecule against cleavage by ribonucleases comprising introducing at least one modified nucleotide into the siNA molecule, wherein the modified nucleotide is a 2'-deoxy-2'-fluoro nucleotide. In another embodiment, all pyrimidine nucleotides present in the siNA are 2'-deoxy-2'-fluoro pyrimidine nucleotides. In another embodiment, the modified nucleotides in the siNA include at least one 2'-deoxy-2'-fluoro cytidine or 2'-deoxy-2'-fluoro uridine nucleotide. In another embodiment, the modified nucleotides in the siNA include at least one 2'-deoxy-2'-fluoro cytidine and at least one 2'-deoxy-2'-fluoro uridine nucleotides. In another embodiment, all uridine nucleotides present in the siNA are 2'-deoxy-2'-fluoro uridine nucleotides. In another embodiment, all cytidine nucleotides present in the siNA are 2'-deoxy-2'-fluoro cytidine nucleotides. In another embodiment, all adenosine nucleotides present in the siNA are 2'-deoxy-2'-fluoro adenosine nucleotides. In another embodiment, all guanosine nucleotides present in the siNA are 2'-deoxy-2'-fluoro guanosine nucleotides. The siNA can further comprise at least one modified internucleotidic linkage, such as phosphorothioate linkage. In another embodiment, the 2'-deoxy-2'-fluoronucleotides are present at specifically selected locations in the siNA that are sensitive to cleavage by ribonucleases, such as locations having pyrimidine nucleotides.

In one embodiment, the invention features a double-stranded short interfering nucleic acid (siNA) molecule that inhibits replication of a hepatitis C virus (HCV) comprising a sense region and an antisense region, wherein the antisense region comprises a nucleotide sequence that is complementary to a nucleotide sequence or a portion thereof of HCV and the sense region comprises a nucleotide sequence that is complementary to the antisense region, and wherein the purine nucleotides present in the antisense region comprise 2'-deoxy-purine nucleotides. In an alternative embodiment, the purine nucleotides present in the antisense region comprise 2'-O-methyl purine nucleotides. In either of the above embodiments, the antisense region can comprise a phosphorothioate internucleotide linkage at the 3' end of the antisense region. Alternatively, in either of the above embodiments, the antisense region can comprise a glyceryl modification at the 3' end of the antisense region. In another embodiment of any of the above described siNA molecules, any nucleotides present in a non-complementary region of the antisense strand (e.g. overhang region) are 2'-deoxy nucleotides.

In one embodiment, the invention features a double-stranded short interfering nucleic acid (siNA) molecule that inhibits replication of a hepatitis C virus (HCV), wherein the siNA molecule is assembled from two separate oligonucleotide fragments wherein one fragment comprises the sense region and the second fragment comprises the antisense region of the siNA molecule. In one embodiment, about 19 nucleotides of each fragment of the siNA molecule are base-paired to the complementary nucleotides of the other fragment of the siNA molecule, wherein at least two 3' terminal nucleotides of each fragment of the siNA molecule are not base-paired to the nucleotides of the other fragment of the siNA molecule. In one embodiment, each of the two 3' terminal nucleotides of each fragment of the siNA molecule is a 2'-deoxy-pyrimidine nucleotide, such as a 2'-deoxy-thymidine. In another embodiment, all 21 nucleotides of each fragment of the siNA molecule are base-paired to the complementary nucleotides of the other fragment of the siNA molecule. In another embodiment, about 19 nucleotides of the antisense region are base-paired to the nucleotide sequence of the HCV RNA or a portion thereof. In another embodiment, about 21 nucleotides of the antisense region are base-paired to the nucleotide sequence of the HCV RNA or a portion thereof. In any of the above embodiments, the 5'-end of the fragment comprising said antisense region can optionally includes a phosphate group.

In one embodiment, the invention features a double-stranded short interfering nucleic acid (siNA) molecule that inhibits the expression of a hepatitis C virus (HCV), wherein the siNA molecule does not contain any ribonucleotides and wherein each strand of the double-stranded siNA molecule is about 21 nucleotides long. Examples of non-ribonucleotide containing siNA constructs are combinations of stabilization chemistries shown in Table IV in any combination of Sense/Antisense chemistries, such as Stab 7/8, Stab 7/11, Stab 8/8, Stab 18/8, Stab 18/11, Stab 12/13, Stab 7/13, or Stab 18/13.

In one embodiment, the invention features a pharmaceutical composition comprising an siNA molecule of the invention in an acceptable carrier or diluent.

In one embodiment, the invention features a medicament comprising an siNA molecule of the invention.

In one embodiment, the invention features an active ingredient comprising an siNA molecule of the invention.

In one embodiment, the nucleotide sequence of the antisense strand or a portion thereof of an siNA molecule of the invention is complementary to the nucleotide sequence of an HCV RNA or a portion thereof that is present in the RNA of all HCV isolates.

In one embodiment, the invention features the use of a double-stranded short interfering nucleic acid (siNA) molecule that inhibits replication of a hepatitis C virus (HCV), wherein one of the strands of said double-stranded siNA molecule is an antisense strand which comprises a nucleotide sequence that is complementary to the nucleotide sequence of an HCV RNA or a portion thereof and the other strand is a sense strand which comprises a nucleotide sequence that is complementary to the nucleotide sequence of the antisense strand, wherein a majority of the pyrimidine nucleotides present in said double-stranded siNA molecule comprises a sugar modification.

In a non-limiting example, the introduction of chemically modified nucleotides into nucleic acid molecules provides a powerful tool in overcoming potential limitations of in vivo stability and bioavailability inherent to native RNA molecules that are delivered exogenously. For example, the use of chemically modified nucleic acid molecules can enable a lower dose of a particular nucleic acid molecule for a given therapeutic effect since chemically modified nucleic acid molecules tend to have a longer half-life in serum. Furthermore, certain chemical modifications can improve the bioavailability of nucleic acid molecules by targeting particular cells or tissues and/or improving cellular uptake of the nucleic acid molecule. Therefore, even if the activity of a chemically modified nucleic acid molecule is reduced as compared to a native nucleic acid molecule, for example, when compared to an all-RNA nucleic acid molecule, the overall activity of the modified nucleic acid molecule can be greater than that of the native molecule due to improved stability and/or delivery of the molecule. Unlike native unmodified siNA, chemically modified siNA can also minimize the possibility of activating interferon activity in humans.

In any of the embodiments of siNA molecules described herein, the antisense region of an siNA molecule of the invention can comprise a phosphorothioate internucleotide linkage at the 3'-end of said antisense region. In any of the embodiments of siNA molecules described herein, the antisense region can comprise about one to about five phosphorothioate internucleotide linkages at the 5'-end of said antisense region. In any of the embodiments of siNA molecules described herein, the 3'-terminal nucleotide overhangs of an siNA molecule of the invention can comprise ribonucleotides or deoxyribonucleotides that are chemically modified at a nucleic acid sugar, base, or backbone. In any of the embodiments of siNA molecules described herein, the 3'-terminal nucleotide overhangs can comprise one or more universal base ribonucleotides. In any of the embodiments of siNA molecules described herein, the 3'-terminal nucleotide overhangs can comprise one or more acyclic nucleotides.

One embodiment of the invention provides an expression vector comprising a nucleic acid sequence encoding at least one siNA molecule of the invention in a manner that allows expression of the nucleic acid molecule. Another embodiment of the invention provides a mammalian cell comprising such an expression vector. The mammalian cell can be a human cell. The siNA molecule of the expression vector can comprise a sense region and an antisense region. The antisense region can comprise a sequence complementary to an RNA or DNA sequence encoding HCV and the sense region can a comprise sequence complementary to the antisense region. The siNA molecule can comprise two distinct strands having complementary sense and antisense regions. The siNA molecule can comprise a single strand having complementary sense and antisense regions.

In one embodiment, the invention features a chemically modified short interfering nucleic acid (siNA) molecule capable of mediating RNA interference (RNAi) against an HCV inside a cell or reconstituted in vitro system, wherein the chemical modification comprises one or more (e.g., about 1, 2, 3, 4, 5, 6, 7, 8, 9, 10, or more) nucleotides comprising a backbone modified internucleotide linkage having Formula I:

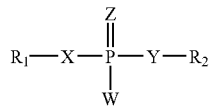

wherein each R1 and R2 is independently any nucleotide, non-nucleotide, or polynucleotide which can be naturally-occurring or chemically modified, each X and Y is independently O, S, N, alkyl, or substituted alkyl, each Z and W is independently O, S, N, alkyl, substituted alkyl, O-alkyl, S-alkyl, alkaryl, aralkyl, or acetyl and wherein W, X, Y, and Z are optionally not all O. In another embodiment, a backbone modification of the invention comprises a phosphonoacetate and/or thiophosphonoacetate internucleotide linkage (see for example Sheehan et al., 2003, Nucleic Acids Research, 31, 4109-4118).

The chemically modified internucleotide linkages having Formula I, for example, wherein any Z, W, X, and/or Y independently comprises a sulphur atom, can be present in one or both oligonucleotide strands of the siNA duplex, for example, in the sense strand, the antisense strand, or both strands. The siNA molecules of the invention can comprise one or more (e.g., about 1, 2, 3, 4, 5, 6, 7, 8, 9, 10, or more) chemically modified internucleotide linkages having Formula I at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically modified internucleotide linkages having Formula I at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine nucleotides with chemically modified internucleotide linkages having Formula I in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine nucleotides with chemically modified internucleotide linkages having Formula I in the sense strand, the antisense strand, or both strands. In another embodiment, an siNA molecule of the invention having internucleotide linkage(s) of Formula I also comprises a chemically modified nucleotide or non-nucleotide having any of Formulae I-VII.

In one embodiment, the invention features a chemically modified short interfering nucleic acid (siNA) molecule capable of mediating RNA interference (RNAi) against an HCV inside a cell or reconstituted in vitro system, wherein the chemical modification comprises one or more (e.g., about 1, 2, 3, 4, 5, 6, 7, 8, 9, 10, or more) nucleotides or non-nucleotides having Formula II:

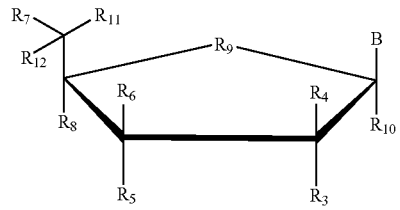

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or group having Formula I or II; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA.

The chemically modified nucleotide or non-nucleotide of Formula II can be present in one or both oligonucleotide strands of the siNA duplex, for example in the sense strand, the antisense strand, or both strands. The siNA molecules of the invention can comprise one or more chemically modified nucleotide or non-nucleotide of Formula II at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically modified nucleotides or non-nucleotides of Formula II at the 5'-end of the sense strand, the antisense strand, or both strands. In another non-limiting example, an exemplary siNA molecule of the invention can comprise about 1 to about 5 or more (e.g., about 1, 2, 3, 4, 5, or more) chemically modified nucleotides or non-nucleotides of Formula II at the 3'-end of the sense strand, the antisense strand, or both strands.

In one embodiment, the invention features a chemically modified short interfering nucleic acid (siNA) molecule capable of mediating RNA interference (RNAi) against an HCV inside a cell or reconstituted in vitro system, wherein the chemical modification comprises one or more (e.g., about 1, 2, 3, 4, 5, 6, 7, 8, 9, 10, or more) nucleotides or non-nucleotides having Formula III:

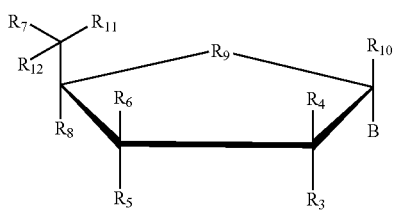

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or group having Formula I or II; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be employed to be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA.

The chemically modified nucleotide or non-nucleotide of Formula III can be present in one or both oligonucleotide strands of the siNA duplex, for example, in the sense strand, the antisense strand, or both strands. The siNA molecules of the invention can comprise one or more chemically modified nucleotide or non-nucleotide of Formula III at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically modified nucleotide(s) or non-nucleotide(s) of Formula III at the 5'-end of the sense strand, the antisense strand, or both strands. In another non-limiting example, an exemplary siNA molecule of the invention can comprise about 1 to about 5 or more (e.g., about 1, 2, 3, 4, 5, or more) chemically modified nucleotide or non-nucleotide of Formula III at the 3'-end of the sense strand, the antisense strand, or both strands.

In another embodiment, an siNA molecule of the invention comprises a nucleotide having Formula II or III, wherein the nucleotide having Formula II or III is in an inverted configuration. For example, the nucleotide having Formula II or III is connected to the siNA construct in a 3'-3',3'-2',2'-3', or 5'-5' configuration, such as at the 3'-end, the 5'-end, or both of the 3' and 5'-ends of one or both siNA strands.

In one embodiment, the invention features a chemically modified short interfering nucleic acid (siNA) molecule capable of mediating RNA interference (RNAi) against an HCV inside a cell or reconstituted in vitro system, wherein the chemical modification comprises a 5'-terminal phosphate group having Formula IV:

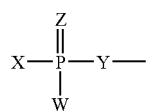

wherein each X and Y is independently O, S, N, alkyl, substituted alkyl, or alkylhalo; wherein each Z and W is independently O, S, N, alkyl, substituted alkyl, O-alkyl, S-alkyl, alkaryl, aralkyl, alkylhalo, or acetyl; and wherein W, X, Y and Z are not all O.

In one embodiment, the invention features an siNA molecule having a 5'-terminal phosphate group having Formula IV on the target-complementary strand, for example, a strand complementary to a target RNA, wherein the siNA molecule comprises an all RNA siNA molecule. In another embodiment, the invention features an siNA molecule having a 5'-terminal phosphate group having Formula IV on the target-complementary strand wherein the siNA molecule also comprises about 1 to about 3 (e.g., about 1, 2, or 3) nucleotide 3'-terminal nucleotide overhangs having about 1 to about 4 (e.g., about 1, 2, 3, or 4) deoxyribonucleotides on the 3'-end of one or both strands. In another embodiment, a 5'-terminal phosphate group having Formula IV is present on the target-complementary strand of an siNA molecule of the invention, for example an siNA molecule having chemical modifications having any of Formulae I-VII.

In one embodiment, the invention features a chemically modified short interfering nucleic acid (siNA) molecule capable of mediating RNA interference (RNAi) against an HCV inside a cell or reconstituted in vitro system, wherein the chemical modification comprises one or more phosphorothioate internucleotide linkages. For example, in a non-limiting example, the invention features a chemically modified short interfering nucleic acid (siNA) having about 1, 2, 3, 4, 5, 6, 7, 8 or more phosphorothioate internucleotide linkages in one siNA strand. In yet another embodiment, the invention features a chemically modified short interfering nucleic acid (siNA) individually having about 1, 2, 3, 4, 5, 6, 7, 8 or more phosphorothioate internucleotide linkages in both siNA strands. The phosphorothioate internucleotide linkages can be present in one or both oligonucleotide strands of the siNA duplex, for example in the sense strand, the antisense strand, or both strands. The siNA molecules of the invention can comprise one or more phosphorothioate internucleotide linkages at the 3'-end, the 5'-end, or both of the 3'- and 5'-ends of the sense strand, the antisense strand, or both strands. For example, an exemplary siNA molecule of the invention can comprise about 1 to about 5 or more (e.g., about 1, 2, 3, 4, 5, or more) consecutive phosphorothioate internucleotide linkages at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine phosphorothioate internucleotide linkages in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine phosphorothioate internucleotide linkages in the sense strand, the antisense strand, or both strands.

In one embodiment, the invention features an siNA molecule, wherein the sense strand comprises one or more, for example, about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically modified with 2'-deoxy, 2'-O-methyl and/or 2'-deoxy-2'-fluoro nucleotides, with or without one or more, for example about 1, 2, 3, 4, 5, 6, 7, 8, 9, 10, or more, phosphorothioate internucleotide linkages and/or a terminal cap molecule at the 3'-end, the 5'-end, or both of the 3'- and 5'-ends, being present in the same or different strand.

In one embodiment, the invention features an siNA molecule, wherein the antisense strand comprises one or more, for example, about 1, 2, 3, 4, 5, 6, 7, 8, 9, 10, or more phosphorothioate internucleotide linkages, and/or about one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically modified with 2'-deoxy, 2'-O-methyl and/or 2'-deoxy-2'-fluoro nucleotides, with or without one or more, for example about 1, 2, 3, 4, 5, 6, 7, 8, 9, 10 or more phosphorothioate internucleotide linkages and/or a terminal cap molecule at the 3'-end, the 5'-end, or both of the 3' and 5'-ends, being present in the same or different strand.

In one embodiment, the invention features a chemically modified short interfering nucleic acid (siNA) molecule having about 1 to about 5, specifically about 1, 2, 3, 4, 5 or more phosphorothioate internucleotide linkages in each strand of the siNA molecule.

In another embodiment, the invention features an siNA molecule comprising 2'-5' internucleotide linkages. The 2'-5' internucleotide linkage(s) can be at the 3'-end, the 5'-end, or both of the 3'- and 5'-ends of one or both siNA sequence strands. In addition, the 2'-5' internucleotide linkage(s) can be present at various other positions within one or both siNA sequence strands, for example, about 1, 2, 3, 4, 5, 6, 7, 8, 9, 10, or more including every internucleotide linkage of a pyrimidine nucleotide in one or both strands of the siNA molecule can comprise a 2'-5' internucleotide linkage, or about 1, 2, 3, 4, 5, 6, 7, 8, 9, 10, or more including every internucleotide linkage of a purine nucleotide in one or both strands of the siNA molecule can comprise a 2'-5' internucleotide linkage.

In another embodiment, a chemically modified siNA molecule of the invention comprises a duplex having two strands, one or both of which can be chemically modified, wherein each strand is about 18 to about 27 (e.g., about 18, 19, 20, 21, 22, 23, 24, 25, 26, or 27) nucleotides in length, wherein the duplex has about 18 to about 23 (e.g., about 18, 19, 20, 21, 22, or 23) base pairs, and wherein the chemical modification comprises a structure having any of Formulae I-VII. For example, an exemplary chemically modified siNA molecule of the invention comprises a duplex having two strands, one or both of which can be chemically modified with a chemical modification having any of Formulae I-VII or any combination thereof, wherein each strand consists of about 21 nucleotides, each having a 2-nucleotide 3'-terminal overhang, and wherein the duplex has about 19 base pairs. In another embodiment, an siNA molecule of the invention comprises a single stranded hairpin structure, wherein the siNA is about 36 to about 70 (e.g., about 36, 40, 45, 50, 55, 60, 65, or 70) nucleotides in length having about 18 to about 23 (e.g., about 18, 19, 20, 21, 22, or 23) base pairs, and wherein the siNA can include a chemical modification comprising a structure having any of Formulae I-VII or any combination thereof. For example, an exemplary chemically modified siNA molecule of the invention comprises a linear oligonucleotide having about 42 to about 50 (e.g., about 42, 43, 44, 45, 46, 47, 48, 49, or 50) nucleotides that is chemically modified with a chemical modification having any of Formulae I-VII or any combination thereof, wherein the linear oligonucleotide forms a hairpin structure having about 19 base pairs and a 2-nucleotide 3'-terminal nucleotide overhang. In another embodiment, a linear hairpin siNA molecule of the invention contains a stem loop motif, wherein the loop portion of the siNA molecule is biodegradable. For example, a linear hairpin siNA molecule of the invention is designed such that degradation of the loop portion of the siNA molecule in vivo can generate a double-stranded siNA molecule with 3'-terminal overhangs, such as 3'-terminal nucleotide overhangs comprising about 2 nucleotides.

In another embodiment, an siNA molecule of the invention comprises a hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs, and wherein the siNA can include one or more chemical modifications comprising a structure having any of Formulae I-VII or any combination thereof. For example, an exemplary chemically modified siNA molecule of the invention comprises a linear oligonucleotide having about 25 to about 35 (e.g., about 25, 26, 27, 28, 29, 30, 31, 32, 33, 34, or 35) nucleotides that is chemically modified with one or more chemical modifications having any of Formulae I-VII or any combination thereof, wherein the linear oligonucleotide forms a hairpin structure having about 3 to about 23 (e.g., about 3, 4, 5, 6, 7, 8, 9, 10, 11, 12, 13, 14, 15, 16, 17, 18, 19, 20, 21, 22, or 23) base pairs and a 5'-terminal phosphate group that can be chemically modified as described herein (for example a 5'-terminal phosphate group having Formula IV). In another embodiment, a linear hairpin siNA molecule of the invention contains a stem loop motif, wherein the loop portion of the siNA molecule is biodegradable. In another embodiment, a linear hairpin siNA molecule of the invention comprises a loop portion comprising a non-nucleotide linker.

In another embodiment, an siNA molecule of the invention comprises an asymmetric hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 20 (e.g., about 3, 4, 5, 6, 7, 8, 9, 10, 11, 12, 13, 14, 15, 16, 17, 18, 19, or 20) base pairs, and wherein the siNA can include one or more chemical modifications comprising a structure having any of Formulae I-VII or any combination thereof. For example, an exemplary chemically modified siNA molecule of the invention comprises a linear oligonucleotide having about 25 to about 35 (e.g., about 25, 26, 27, 28, 29, 30, 31, 32, 33, 34, or 35) nucleotides that is chemically modified with one or more chemical modifications having any of Formulae I-VII or any combination thereof, wherein the linear oligonucleotide forms an asymmetric hairpin structure having about 3 to about 18 (e.g., about 3, 4, 5, 6, 7, 8, 9, 10, 11, 12, 13, 14, 15, 16, 17 or 18) base pairs and a 5'-terminal phosphate group that can be chemically modified as described herein (for example a 5'-terminal phosphate group having Formula IV). In another embodiment, an asymmetric hairpin siNA molecule of the invention contains a stem loop motif, wherein the loop portion of the siNA molecule is biodegradable. In another embodiment, an asymmetric hairpin siNA molecule of the invention comprises a loop portion comprising a non-nucleotide linker.

In another embodiment, an siNA molecule of the invention comprises an asymmetric double-stranded structure having separate polynucleotide strands comprising sense and antisense regions, wherein the antisense region is about 16 to about 25 (e.g., about 16, 17, 18, 19, 20, 21, 22, 23, 24, or 25) nucleotides in length, wherein the sense region is about 3 to about 18 (e.g., about 3, 4, 5, 6, 7, 8, 9, 10, 11, 12, 13, 14, 15, 16, 17, or 18) nucleotides in length, wherein the sense region the antisense region have at least 3 complementary nucleotides, and wherein the siNA can include one or more chemical modifications comprising a structure having any of Formulae I-VII or any combination thereof. For example, an exemplary chemically modified siNA molecule of the invention comprises an asymmetric double-stranded structure having separate polynucleotide strands comprising sense and antisense regions, wherein the antisense region is about 18 to about 22 (e.g., about 18, 19, 20, 21, or 22) nucleotides in length and wherein the sense region is about 3 to about 15 (e.g., about 3, 4, 5, 6, 7, 8, 9, 10, 11, 12, 13, 14, or 15) nucleotides in length, wherein the sense region the antisense region have at least 3 complementary nucleotides, and wherein the siNA can include one or more chemical modifications comprising a structure having any of Formulae I-VII or any combination thereof. In another embodiment, the asymmetric double-stranded siNA molecule can also have a 5'-terminal phosphate group that can be chemically modified as described herein (for example a 5'-terminal phosphate group having Formula IV).

In another embodiment, an siNA molecule of the invention comprises a circular nucleic acid molecule, wherein the siNA is about 38 to about 70 (e.g., about 38, 40, 45, 50, 55, 60, 65, or 70) nucleotides in length having about 18 to about 23 (e.g., about 18, 19, 20, 21, 22, or 23) base pairs, and wherein the siNA can include a chemical modification, which comprises a structure having any of Formulae I-VII or any combination thereof. For example, an exemplary chemically modified siNA molecule of the invention comprises a circular oligonucleotide having about 42 to about 50 (e.g., about 42, 43, 44, 45, 46, 47, 48, 49, or 50) nucleotides that is chemically modified with a chemical modification having any of Formulae I-VII or any combination thereof, wherein the circular oligonucleotide forms a dumbbell shaped structure having about 19 base pairs and 2 loops.

In another embodiment, a circular siNA molecule of the invention contains two loop motifs, wherein one or both loop portions of the siNA molecule is biodegradable. For example, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In one embodiment, an siNA molecule of the invention comprises at least one (e.g., about 1, 2, 3, 4, 5, 6, 7, 8, 9, 10, or more) abasic moiety, for example a compound having Formula V:

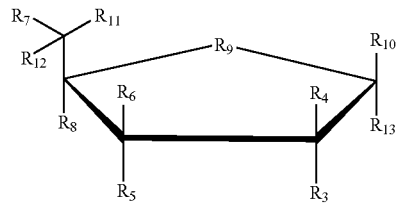

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or group having Formula I or II; R9 is O, S, CH2, S=O, CHF, or CF2.

In one embodiment, an siNA molecule of the invention comprises at least one (e.g., about 1, 2, 3, 4, 5, 6, 7, 8, 9, 10, or more) inverted abasic moiety, for example a compound having Formula VI:

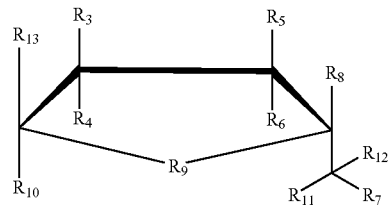

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or group having Formula I or II; R9 is O, S, CH2, S=O, CHF, or CF2, and either R5, R3, R8 or R13 serves as a point of attachment to the siNA molecule of the invention.

In another embodiment, an siNA molecule of the invention comprises at least one (e.g., about 1, 2, 3, 4, 5, 6, 7, 8, 9, 10, or more) substituted polyalkyl moieties, for example a compound having Formula VII:

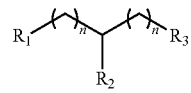

wherein each n is independently an integer from 1 to 12, each R1, R2 and R3 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or a group having Formula I, and R1, R2 or R3 serves as points of attachment to the siNA molecule of the invention.

In another embodiment, the invention features a compound having Formula VII, wherein R1 and R2 are hydroxyl (OH) groups, n=1, and R3 comprises 0 and is the point of attachment to the 3'-end, the 5'-end, or both of the 3' and 5'-ends of one or both strands of a double-stranded siNA molecule of the invention or to a single-stranded siNA molecule of the invention. This modification is referred to herein as "glyceryl" (for example see modification 6 in FIG. 10).

In another embodiment, a moiety having any of Formula V, VI or VII of the invention is at the 3'-end, the 5'-end, or both of the 3' and 5'-ends of an siNA molecule of the invention. For example, a moiety having Formula V, VI or VII can be present at the 3'-end, the 5'-end, or both of the 3' and 5'-ends of the antisense strand, the sense strand, or both antisense and sense strands of the siNA molecule. In addition, a moiety having Formula VII can be present at the 3'-end or the 5'-end of a hairpin siNA molecule as described herein.

In another embodiment, an siNA molecule of the invention comprises an abasic residue having Formula V or VI, wherein the abasic residue having Formula V or VI is connected to the siNA construct in a 3'-3',3'-2',2'-3', or 5'-5' configuration, such as at the 3'-end, the 5'-end, or both of the 3' and 5'-ends of one or both siNA strands.

In one embodiment, an siNA molecule of the invention comprises one or more (e.g., about 1, 2, 3, 4, 5, 6, 7, 8, 9, 10, or more) locked nucleic acid (LNA) nucleotides, for example at the 5'-end, the 3'-end, both of the 5' and 3'-ends, or any combination thereof, of the siNA molecule.

In another embodiment, an siNA molecule of the invention comprises one or more (e.g., about 1, 2, 3, 4, 5, 6, 7, 8, 9, 10, or more) acyclic nucleotides, for example at the 5'-end, the 3'-end, both of the 5' and 3'-ends, or any combination thereof, of the siNA molecule.

In one embodiment, the invention features a chemically modified short interfering nucleic acid (siNA) molecule of the invention, wherein the chemically modified siNA comprises a sense region, where any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and where any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically modified short interfering nucleic acid (siNA) molecule of the invention, wherein the chemically modified siNA comprises a sense region, where any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and where any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), wherein any nucleotides comprising a 3'-terminal nucleotide overhang that are present in said sense region are 2'-deoxy nucleotides.

In one embodiment, the invention features a chemically modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the sense region are 2'-O-methyl purine nucleotides (e.g., wherein all purine nucleotides are 2'-O-methyl purine nucleotides or alternately a plurality of purine nucleotides are 2'-O-methyl purine nucleotides).

In one embodiment, the invention features a chemically modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the sense region are 2'-O-methyl purine nucleotides (e.g., wherein all purine nucleotides are 2'-O-methyl purine nucleotides or alternately a plurality of purine nucleotides are 2'-O-methyl purine nucleotides), wherein any nucleotides comprising a 3'-terminal nucleotide overhang that are present in said sense region are 2'-deoxy nucleotides.

In one embodiment, the invention features a chemically modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides).

In one embodiment, the invention features a chemically modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides), wherein any nucleotides comprising a 3'-terminal nucleotide overhang that are present in said antisense region are 2'-deoxy nucleotides.

In one embodiment, the invention features a chemically modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides).

In one embodiment, the invention features a chemically modified short interfering nucleic acid (siNA) molecule of the invention capable of mediating RNA interference (RNAi) against HCV inside a cell or reconstituted in vitro system comprising a sense region, wherein one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and an antisense region, wherein one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). The sense region and/or the antisense region can have a terminal cap modification, such as any modification described herein or shown in FIG. 10, that is optionally present at the 3'-end, the 5'-end, or both of the 3' and 5'-ends of the sense and/or antisense sequence. The sense and/or antisense region can optionally further comprise a 3'-terminal nucleotide overhang having about 1 to about 4 (e.g., about 1, 2, 3, or 4) 2'-deoxy-nucleotides. The overhang nucleotides can further comprise one or more (e.g., about 1, 2, 3, 4 or more) phosphorothioate, phosphonoacetate, and/or thiophosphonoacetate internucleotide linkages. Non-limiting examples of these chemically modified siNAs are shown in FIGS. 4 and 5 and Tables III and IV herein. In any of these described embodiments, one or more of the purine nucleotides present in the sense region are alternatively 2'-O-methyl purine nucleotides (e.g., wherein all purine nucleotides are 2'-O-methyl purine nucleotides or alternately a plurality of purine nucleotides are 2'-O-methyl purine nucleotides) and one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). Also, in any of these embodiments, one or more purine nucleotides present in the sense region are alternatively purine ribonucleotides (e.g., wherein all purine nucleotides are purine ribonucleotides or alternately a plurality of purine nucleotides are purine ribonucleotides) and any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). Additionally, in any of these embodiments, one or more purine nucleotides present in the sense region and/or present in the antisense region are alternatively selected from the group consisting of 2'-deoxy nucleotides, locked nucleic acid (LNA) nucleotides, 2'-methoxyethyl nucleotides, 4'-thionucleotides, and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides). In another embodiment, any modified nucleotides present in the siNA molecules of the invention, preferably in the antisense strand of the siNA molecules of the invention, but also optionally in the sense and/or both antisense and sense strands, comprise modified nucleotides having properties or characteristics similar to naturally occurring ribonucleotides. For example, the invention features siNA molecules including modified nucleotides having a Northern conformation (e.g., Northern pseudo-rotation cycle, see for example Saenger, *Principles of Nucleic Acid Structure*, Springer-Verlag ed., 1984). As such, chemically modified nucleotides present in the siNA molecules of the invention, preferably in the antisense strand of the siNA molecules of the invention, but also optionally in the sense and/or both antisense and sense strands, are resistant to nuclease degradation while at the same time maintaining the capacity to mediate RNAi. Non-limiting examples of nucleotides having a Northern configuration include locked nucleic acid (LNA) nucleotides (e.g., 2'-O, 4'-C-methylene-(D-ribofuranosyl) nucleotides); 2'-methoxyethoxy (MOE) nucleotides; 2'-methyl-thio-ethyl nucleotides, 2'-deoxy-2'-fluoro nucleotides, 2'-deoxy-2'-chloro nucleotides, 2'-azido nucleotides, and 2'-O-methyl nucleotides. In any of the embodiments, the sense strand of a double-stranded siNA molecule of the invention comprises a terminal cap moiety, (see for example FIG. 10) such as an inverted deoxyabasic moiety, at the 3'-end, 5'-end, or both 3' and 5'-ends of the sense strand.

In one embodiment, the invention features a chemically modified short interfering nucleic acid molecule (siNA) capable of mediating RNA interference (RNAi) against HCV inside a cell or reconstituted in vitro system, wherein the chemical modification comprises a conjugate covalently attached to the chemically modified siNA molecule. Non-limiting examples of conjugates contemplated by the invention include conjugates and ligands described in Vargeese et al., U.S. Ser. No. 10/427,160, filed Apr. 30, 2003, incorporated by reference herein in its entirety, including the drawings. In another embodiment, the conjugate is covalently attached to the chemically modified siNA molecule via a biodegradable linker. In one embodiment, the conjugate molecule is attached at the 3'-end of either the sense strand, the antisense strand, or both strands of the chemically modified siNA molecule. In another embodiment, the conjugate molecule is attached at the 5'-end of either the sense strand, the antisense strand, or both strands of the chemically modified siNA molecule. In yet another embodiment, the conjugate molecule is attached both the 3'-end and 5'-end of either the sense strand, the antisense strand, or both strands of the chemically modified siNA molecule, or any combination thereof. In one embodiment, a conjugate molecule of the invention comprises a molecule that facilitates delivery of a chemically modified siNA molecule into a biological system, such as a cell. In another embodiment, the conjugate molecule attached to the chemically modified siNA molecule is a poly ethylene glycol, human serum albumin, or a ligand for a cellular receptor that can mediate cellular uptake. Examples of specific conjugate molecules contemplated by the instant invention that can be attached to chemically modified siNA molecules are described in Vargeese et al., U.S. Ser. No. 10/201,394, incorporated by reference herein. The type of conjugates used and the extent of conjugation of siNA molecules of the invention can be evaluated for improved pharmacokinetic profiles, bioavailability, and/or stability of siNA constructs while at the same time maintaining the ability of the siNA to mediate RNAi activity. As such, one skilled in the art can screen siNA constructs that are modified with various conjugates to determine whether the siNA conjugate complex possesses improved properties while maintaining the ability to mediate RNAi, for example in animal models as are generally known in the art.

In one embodiment, the invention features a short interfering nucleic acid (siNA) molecule of the invention, wherein the siNA further comprises a nucleotide, non-nucleotide, or mixed nucleotide/non-nucleotide linker that joins the sense region of the siNA to the antisense region of the siNA. In one embodiment, a nucleotide linker of the invention can be a linker of ≧2 nucleotides in length, for example about 3, 4, 5, 6, 7, 8, 9, or 10 nucleotides in length. In another embodiment, the nucleotide linker can be a nucleic acid aptamer. By "aptamer" or "nucleic acid aptamer" as used herein is meant a nucleic acid molecule that binds specifically to a target molecule wherein the nucleic acid molecule has a sequence that comprises a sequence recognized by the target molecule in its natural setting. Alternately, an aptamer can be a nucleic acid molecule that binds to a target molecule where the target molecule does not naturally bind to a nucleic acid. The target molecule can be any molecule of interest. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art. (See, for example, Gold et al., 1995, *Annu. Rev. Biochem.*, 64, 763; Brody and Gold, 2000, *J. Biotechnol.*, 74, 5; Sun, 2000, *Curr. Opin. Mol. Ther.*, 2, 100; Kusser, 2000, *J. Biotechnol.*, 74, 27; Hermann and Patel, 2000, *Science*, 287, 820; and Jayasena, 1999, *Clinical Chemistry*, 45, 1628.)

In yet another embodiment, a non-nucleotide linker of the invention comprises abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, *Nucleic Acids Res.* 1990, 18:6353 and *Nucleic Acids Res.* 1987, 15:3113; Cload and Schepartz, *J. Am. Chem. Soc.* 1991, 113:6324; Richardson and Schepartz, *J. Am. Chem. Soc.* 1991, 113:5109; Ma et al., *Nucleic Acids Res.* 1993, 21:2585 and *Biochemistry* 1993, 32:1751; Durand et al., *Nucleic Acids Res.* 1990, 18:6353; McCurdy et al., *Nucleosides & Nucleotides* 1991, 10:287; Jschke et al., *Tetrahedron Lett.* 1993, 34:301; Ono et al., *Biochemistry* 1991, 30:9914; Arnold et al., International Publication No. WO 89/02439; Usman et al., International Publication No. WO 95/06731; Dudycz et al., International Publication No. WO 95/11910 and Ferentz and Verdine, *J. Am. Chem. Soc.* 1991, 113:4000, all hereby incorporated by reference herein. A "non-nucleotide" further means any group or compound that can be incorporated into a nucleic acid chain in the place of one or more nucleotide units, including either sugar and/or phosphate substitutions, and allows the remaining bases to exhibit their enzymatic activity. The group or compound can be abasic in that it does not contain a commonly recognized nucleotide base, such as adenosine, guanine, cytosine, uracil or thymine, for example at the C1 position of the sugar.

In one embodiment, the invention features a short interfering nucleic acid (siNA) molecule capable of mediating RNA interference (RNAi) inside a cell or reconstituted in vitro system, wherein one or both strands of the siNA molecule that are assembled from two separate oligonucleotides do not comprise any ribonucleotides. For example, an siNA molecule can be assembled from a single oligonucleotide where the sense and antisense regions of the siNA comprise separate oligonucleotides not having any ribonucleotides (e.g., nucleotides having a 2'-OH group) present in the oligonucleotides. In another example, an siNA molecule can be assembled from a single oligonucleotide where the sense and antisense regions of the siNA are linked or circularized by a nucleotide or non-nucleotide linker as described herein, wherein the oligonucleotide does not have any ribonucleotides (e.g., nucleotides having a 2'-OH group) present in the oligonucleotide. Applicant has surprisingly found that the presence of ribonucleotides (e.g., nucleotides having a 2'-hydroxyl group) within the siNA molecule is not required or essential to support RNAi activity. As such, in one embodiment, all positions within the siNA can include chemically modified nucleotides and/or non-nucleotides such as nucleotides and or non-nucleotides having Formula I, II, III, IV, V, VI, or VII or any combination thereof to the extent that the ability of the siNA molecule to support RNAi activity in a cell is maintained.

In one embodiment, an siNA molecule of the invention is a single stranded siNA polynucleotide that mediates RNAi activity in a cell or reconstituted in vitro system, wherein the single stranded polynucleotide has complementarity to a target nucleic acid sequence. In another embodiment, the single stranded siNA molecule of the invention comprises a 5'-terminal phosphate group. In another embodiment, the single stranded siNA molecule of the invention comprises a 5'-terminal phosphate group and a 3'-terminal phosphate group (e.g., a 2',3'-cyclic phosphate). In another embodiment, the single stranded siNA molecule of the invention comprises about 19 to about 29 (e.g., about 19, 20, 21, 22, 23, 24, 25, 26, 27, 28, or 29) nucleotides. In yet another embodiment, the single stranded siNA molecule of the invention comprises one or more chemically modified nucleotides or non-nucleotides described herein. For example, all the positions within the siNA molecule can include chemically modified nucleotides such as nucleotides having any of Formulae I-VII, or any combination thereof to the extent that the ability of the siNA molecule to support RNAi activity in a cell is maintained.

In one embodiment, an siNA molecule of the invention is a single stranded siNA molecule that mediates RNAi activity in a cell or reconstituted in vitro system comprising a single stranded polynucleotide having complementarity to a target nucleic acid sequence, wherein one or more pyrimidine nucleotides present in the siNA are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides), and a terminal cap modification, such as any modification described herein or shown in FIG. 10, that is optionally present at the 3'-end, or the 5'-end of the antisense sequence. The siNA optionally further comprises about 1 to about 4 or more (e.g., about 1, 2, 3, 4 or more) terminal 2'-deoxynucleotides at the 3'-end of the siNA molecule, wherein the terminal nucleotides can further comprise one or more (e.g., 1, 2, 3, 4 or more) phosphorothioate, phosphonoacetate, and/or thiophosphonoacetate internucleotide linkages, and wherein the siNA optionally further comprises a terminal phosphate group, such as a 5'-terminal phosphate group. In any of these embodiments, any purine nucleotides present in the antisense region are alternatively 2'-deoxy purine nucleotides (e.g., wherein all purine nucleotides are 2'-deoxy purine nucleotides or alternately a plurality of purine nucleotides are 2'-deoxy purine nucleotides). Also, in any of these embodiments, any purine nucleotides present in the siNA (i.e., purine nucleotides present in the sense and/or antisense region) can alternatively be locked nucleic acid (LNA) nucleotides (e.g., wherein all purine nucleotides are LNA nucleotides or alternately a plurality of purine nucleotides are LNA nucleotides). Also, in any of these embodiments, any purine nucleotides present in the siNA are alternatively 2'-methoxyethyl purine nucleotides (e.g., wherein all purine nucleotides are 2'-methoxyethyl purine nucleotides or alternately a plurality of purine nucleotides are 2'-methoxyethyl purine nucleotides). In another embodiment, any modified nucleotides present in the single stranded siNA molecules of the invention comprise modified nucleotides having properties or characteristics similar to naturally occurring ribonucleotides. For example, the invention features siNA molecules including modified nucleotides having a Northern conformation (e.g., Northern pseudo-rotation cycle, see for example Saenger, *Principles of Nucleic Acid Structure*, Springer-Verlag ed., 1984). As such, chemically modified nucleotides present in the single stranded siNA molecules of the invention are preferably resistant to nuclease degradation while at the same time maintaining the capacity to mediate RNAi.

In one embodiment, the invention features a method for modulating the expression of an HCV gene within a cell comprising: (a) synthesizing an siNA molecule of the invention, which can be chemically modified, wherein one of the siNA strands comprises a sequence complementary to RNA of the HCV gene; and (b) introducing the siNA molecule into a cell under conditions suitable to modulate the expression of the HCV gene in the cell.

In one embodiment, the invention features a method for modulating the expression of an HCV gene within a cell comprising: (a) synthesizing an siNA molecule of the invention, which can be chemically modified, wherein one of the siNA strands comprises a sequence complementary to RNA of the HCV gene and wherein the sense strand sequence of the siNA comprises a sequence identical or substantially similar to the sequence of the target RNA; and (b) introducing the siNA molecule into a cell under conditions suitable to modulate the expression of the HCV gene in the cell.

In another embodiment, the invention features a method for modulating the expression of more than one HCV gene within a cell comprising: (a) synthesizing siNA molecules of the invention, which can be chemically modified, wherein one of the siNA strands comprises a sequence complementary to RNA of the HCV genes; and (b) introducing the siNA molecules into a cell under conditions suitable to modulate the expression of the HCV genes in the cell.

In another embodiment, the invention features a method for modulating the expression of two or more HCV genes within a cell comprising: (a) synthesizing one or more siNA molecules of the invention, which can be chemically-modified, wherein the siNA strands comprise sequences complementary to RNA of the HCV genes and wherein the sense strand sequences of the siNAs comprise sequences identical or substantially similar to the sequences of the target RNAs; and (b) introducing the siNA molecules into a cell under conditions suitable to modulate the expression of the HCV genes in the cell.

In another embodiment, the invention features a method for modulating the expression of more than one HCV gene within a cell comprising: (a) synthesizing a siNA molecule of the invention, which can be chemically modified, wherein one of the siNA strands comprises a sequence complementary to RNA of the HCV gene and wherein the sense strand sequence of the siNA comprises a sequence identical or substantially similar to the sequences of the target RNA; and (b) introducing the siNA molecule into a cell under conditions suitable to modulate the expression of the HCV genes in the cell.

In one embodiment, the invention features a method of modulating the expression of an HCV gene in a tissue explant comprising: (a) synthesizing an siNA molecule of the invention, which can be chemically modified, wherein one of the siNA strands comprises a sequence complementary to RNA of the HCV gene; and (b) introducing the siNA molecule into a cell of the tissue explant derived from a particular organism under conditions suitable to modulate the expression of the HCV gene in the tissue explant. In another embodiment, the method further comprises introducing the tissue explant back into the organism the tissue was derived from or into another organism under conditions suitable to modulate the expression of the HCV gene in that organism.

In one embodiment, the invention features a method of modulating the expression of an HCV gene in a tissue explant comprising: (a) synthesizing an siNA molecule of the invention, which can be chemically modified, wherein one of the siNA strands comprises a sequence complementary to RNA of the HCV gene and wherein the sense strand sequence of the siNA comprises a sequence identical or substantially similar to the sequence of the target RNA; and (b) introducing the siNA molecule into a cell of the tissue explant derived from a particular organism under conditions suitable to modulate the expression of the HCV gene in the tissue explant. In another embodiment, the method further comprises introducing the tissue explant back into the organism the tissue was derived from or into another organism under conditions suitable to modulate the expression of the HCV gene in that organism.

In another embodiment, the invention features a method of modulating the expression of more than one HCV gene in a tissue explant comprising: (a) synthesizing siNA molecules of the invention, which can be chemically modified, wherein one of the siNA strands comprises a sequence complementary to RNA of the HCV genes; and (b) introducing the siNA molecules into a cell of the tissue explant derived from a particular organism under conditions suitable to modulate the expression of the HCV genes in the tissue explant. In another embodiment, the method further comprises introducing the tissue explant back into the organism the tissue was derived from or into another organism under conditions suitable to modulate the expression of the HCV genes in that organism.

In one embodiment, the invention features a method of modulating the expression of an HCV gene in an organism comprising: (a) synthesizing an siNA molecule of the invention, which can be chemically modified, wherein one of the siNA strands comprises a sequence complementary to RNA of the HCV gene; and (b) introducing the siNA molecule into the organism under conditions suitable to modulate the expression of the HCV gene in the organism.

In another embodiment, the invention features a method of modulating the expression of more than one HCV gene in an organism comprising: (a) synthesizing siNA molecules of the invention, which can be chemically modified, wherein one of the siNA strands comprises a sequence complementary to RNA of the HCV genes; and (b) introducing the siNA molecules into the organism under conditions suitable to modulate the expression of the HCV genes in the organism.

In one embodiment, the invention features a method for modulating the expression of an HCV gene within a cell comprising: (a) synthesizing an siNA molecule of the invention, which can be chemically modified, wherein the siNA comprises a single stranded sequence having complementarity to RNA of the HCV gene; and (b) introducing the siNA molecule into a cell under conditions suitable to modulate the expression of the HCV gene in the cell.

In another embodiment, the invention features a method for modulating the expression of more than one HCV gene within a cell comprising: (a) synthesizing siNA molecules of the invention, which can be chemically modified, wherein the siNA comprises a single stranded sequence having complementarity to RNA of the HCV gene; and (b) contacting a cell in vitro or in vivo with the siNA molecule under conditions suitable to modulate the expression of the HCV genes in the cell.

In one embodiment, the invention features a method of modulating the expression of an HCV gene in a tissue explant comprising: (a) synthesizing an siNA molecule of the invention, which can be chemically modified, wherein the siNA comprises a single stranded sequence having complementarity to RNA of the HCV gene; and (b) contacting the siNA molecule with a cell of the tissue explant derived from a particular organism under conditions suitable to modulate the expression of the HCV gene in the tissue explant. In another embodiment, the method further comprises introducing the tissue explant back into the organism the tissue was derived from or into another organism under conditions suitable to modulate the expression of the HCV gene in that organism.

In another embodiment, the invention features a method of modulating the expression of more than one HCV gene in a tissue explant comprising: (a) synthesizing siNA molecules of the invention, which can be chemically modified, wherein the siNA comprises a single stranded sequence having complementarity to RNA of the HCV gene; and (b) introducing the siNA molecules into a cell of the tissue explant derived from a particular organism under conditions suitable to modulate the expression of the HCV genes in the tissue explant. In another embodiment, the method further comprises introducing the tissue explant back into the organism the tissue was derived from or into another organism under conditions suitable to modulate the expression of the HCV genes in that organism.

In one embodiment, the invention features a method of modulating the expression of an HCV gene in an organism comprising: (a) synthesizing an siNA molecule of the invention, which can be chemically modified, wherein the siNA comprises a single stranded sequence having complementarity to RNA of the HCV gene; and (b) introducing the siNA molecule into the organism under conditions suitable to modulate the expression of the HCV gene in the organism.

In another embodiment, the invention features a method of modulating the expression of more than one HCV gene in an organism comprising: (a) synthesizing siNA molecules of the invention, which can be chemically modified, wherein the siNA comprises a single stranded sequence having complementarity to RNA of the HCV gene; and (b) introducing the siNA molecules into the organism under conditions suitable to modulate the expression of the HCV genes in the organism.

In one embodiment, the invention features a method of modulating the expression of an HCV gene in an organism comprising contacting the organism with an siNA molecule of the invention under conditions suitable to modulate the expression of the HCV gene in the organism.

In another embodiment, the invention features a method of modulating the expression of more than one HCV gene in an organism comprising contacting the organism with one or more siNA molecules of the invention under conditions suitable to modulate the expression of the HCV genes in the organism.

The siNA molecules of the invention can be designed to inhibit, down regulate or target (HCV) gene expression through RNAi targeting of a variety of RNA molecules. In one embodiment, the siNA molecules of the invention are used to target various RNAs corresponding to a target gene. Non-limiting examples of such RNAs include messenger RNA (mRNA), alternate RNA splice variants of target gene(s), post-transcriptionally modified RNA of target gene(s), pre-mRNA of target gene(s), and/or RNA templates. If alternate splicing produces a family of transcripts that are distinguished by usage of appropriate exons, the instant invention can be used to inhibit gene expression through the appropriate exons to specifically inhibit or to distinguish among the functions of gene family members. For example, a protein that contains an alternatively spliced transmembrane domain can be expressed in both membrane bound and secreted forms. Use of the invention to target the exon containing the transmembrane domain can be used to determine the functional consequences of pharmaceutical targeting of membrane bound as opposed to the secreted form of the protein. Non-limiting examples of applications of the invention relating to targeting these RNA molecules include therapeutic pharmaceutical applications, pharmaceutical discovery applications, molecular diagnostic and gene function applications, and gene mapping, for example using single nucleotide polymorphism mapping with siNA molecules of the invention. Such applications can be implemented using known gene sequences or from partial sequences available from an expressed sequence tag (EST).

In another embodiment, the siNA molecules of the invention are used to target conserved sequences corresponding to a gene family or gene families such as HCV family genes. As such, siNA molecules targeting multiple HCV targets can provide increased therapeutic effect. In addition, siNA can be used to characterize pathways of gene function in a variety of applications. For example, the present invention can be used to inhibit the activity of target gene(s) in a pathway to determine the function of uncharacterized gene(s) in gene function analysis, mRNA function analysis, or translational analysis. The invention can be used to determine potential target gene pathways involved in various diseases and conditions toward pharmaceutical development. The invention can be used to understand pathways of gene expression involved in, for example, the progression and/or maintenance of HCV infection, liver failure, hepatocellular carcinoma, cirrhosis and other indications that can respond to the level of HCV in a cell or tissue.

In one embodiment, siNA molecule(s) and/or methods of the invention are used to inhibit or down regulate the expression of gene(s) that encode RNA referred to by Genbank Accession numbers, for example HCV genes encoding RNA sequence(s) referred to herein by Genbank Accession number, for example Genbank Accession Nos. shown in Table I.

In one embodiment, the invention features a method comprising: (a) generating a library of siNA constructs having a predetermined complexity; and (b) assaying the siNA constructs of (a) above, under conditions suitable to determine RNAi target sites within the target RNA sequence. In another embodiment, the siNA molecules of (a) have strands of a fixed length, for example, about 23 nucleotides in length. In yet another embodiment, the siNA molecules of (a) are of differing length, for example having strands of about 19 to about 25 (e.g., about 19, 20, 21, 22, 23, 24, or 25) nucleotides in length. In one embodiment, the assay can comprise a reconstituted in vitro siNA assay as described herein. In another embodiment, the assay can comprise a cell culture system in which target RNA is expressed. In another embodiment, fragments of target RNA are analyzed for detectable levels of cleavage, for example by gel electrophoresis, Northern blot analysis, or RNAse protection assays, to determine the most suitable target site(s) within the target RNA sequence. The target RNA sequence can be obtained as is known in the art, for example, by cloning and/or transcription for in vitro systems, and by cellular expression in in vivo systems.

In one embodiment, the invention features a method comprising: (a) generating a randomized library of siNA constructs having a predetermined complexity, such as of $4^N$, where N represents the number of base paired nucleotides in each of the siNA construct strands (e.g. for an siNA construct having 21 nucleotide sense and antisense strands with 19 base pairs, the complexity would be $4^{19}$); and (b) assaying the siNA constructs of (a) above, under conditions suitable to determine RNAi target sites within the target HCV RNA sequence. In another embodiment, the siNA molecules of (a) have strands of a fixed length, for example about 23 nucleotides in length. In yet another embodiment, the siNA molecules of (a) are of differing length, for example having strands of about 19 to about 25 (e.g., about 19, 20, 21, 22, 23, 24, or 25) nucleotides in length. In one embodiment, the assay can comprise a reconstituted in vitro siNA assay as described in Example 6 herein. In another embodiment, the assay can comprise a cell culture system in which target RNA is expressed. In another embodiment, fragments of HCV RNA are analyzed for detectable levels of cleavage, for example by gel electrophoresis, Northern blot analysis, or RNAse protection assays, to determine the most suitable target site(s) within the target HCV RNA sequence. The target HCV RNA sequence can be obtained as is known in the art, for example, by cloning and/or transcription for in vitro systems, and by cellular expression in in vivo systems.

In another embodiment, the invention features a method comprising: (a) analyzing the sequence of a RNA target encoded by a target gene; (b) synthesizing one or more sets of siNA molecules having sequence complementary to one or more regions of the RNA of (a); and (c) assaying the siNA molecules of (b) under conditions suitable to determine RNAi targets within the target RNA sequence. In one embodiment, the siNA molecules of (b) have strands of a fixed length, for example about 23 nucleotides in length. In another embodiment, the siNA molecules of (b) are of differing length, for example having strands of about 19 to about 25 (e.g., about 19, 20, 21, 22, 23, 24, or 25) nucleotides in length. In one embodiment, the assay can comprise a reconstituted in vitro siNA assay as described herein. In another embodiment, the assay can comprise a cell culture system in which target RNA is expressed. Fragments of target RNA are analyzed for detectable levels of cleavage, for example by gel electrophoresis, Northern blot analysis, or RNAse protection assays, to determine the most suitable target site(s) within the target RNA sequence. The target RNA sequence can be obtained as is known in the art, for example, by cloning and/or transcription for in vitro systems, and by expression in in vivo systems.

By "target site" is meant a sequence within a target RNA that is "targeted" for cleavage mediated by an siNA construct which contains sequences within its antisense region that are complementary to the target sequence.

By "detectable level of cleavage" is meant cleavage of target RNA (and formation of cleaved product RNAs) to an extent sufficient to discern cleavage products above the background of RNAs produced by random degradation of the target RNA. Production of cleavage products from 1-5% of the target RNA is sufficient to detect above the background for most methods of detection.

In one embodiment, the invention features a composition comprising an siNA molecule of the invention, which can be chemically modified, in a pharmaceutically acceptable carrier or diluent. In another embodiment, the invention features a pharmaceutical composition comprising siNA molecules of the invention, which can be chemically modified, targeting one or more genes in a pharmaceutically acceptable carrier or diluent. In another embodiment, the invention features a method for diagnosing a disease or condition in a subject comprising administering to the subject a composition of the invention under conditions suitable for the diagnosis of the disease or condition in the subject. In another embodiment, the invention features a method for treating or preventing a disease or condition in a subject, comprising administering to the subject a composition of the invention under conditions suitable for the treatment or prevention of the disease or condition in the subject, alone or in conjunction with one or more other therapeutic compounds.

In another embodiment, the invention features a method for validating an HCV gene target comprising: (a) synthesizing an siNA molecule of the invention, which can be chemically modified, wherein one of the siNA strands comprises a sequence complementary to RNA of an HCV target gene; (b) introducing the siNA molecule into a cell, tissue, or organism under conditions suitable for modulating expression of the HCV target gene in the cell, tissue, or organism; and (c) determining the function of the gene by assaying for any phenotypic change in the cell, tissue, or organism.

In another embodiment, the invention features a method for validating an HCV gene target comprising: (a) synthesizing an siNA molecule of the invention, which can be chemically modified, wherein one of the siNA strands includes a sequence complementary to RNA of an HCV target gene; (b) introducing the siNA molecule into a biological system under conditions suitable for modulating expression of the HCV target gene in the biological system; and (c) determining the function of the gene by assaying for any phenotypic change in the biological system.

By "biological system" is meant, material, in a purified or unpurified form, from biological sources, including but not limited to human, animal, plant, insect, bacterial, viral or other sources, wherein the system comprises the components required for RNAi activity. The term "biological system" includes, for example, a cell, tissue, or organism, or extract thereof. The term biological system also includes reconstituted RNAi systems that can be used in an in vitro setting.

By "phenotypic change" is meant any detectable change to a cell that occurs in response to contact or treatment with a nucleic acid molecule of the invention (e.g., siNA). Such detectable changes include, but are not limited to, changes in shape, size, proliferation, motility, protein expression or RNA expression or other physical or chemical changes as can be assayed by methods known in the art. The detectable change can also include expression of reporter genes/molecules such as Green Florescent Protein (GFP) or various tags that are used to identify an expressed protein or any other cellular component that can be assayed.

In one embodiment, the invention features a kit containing an siNA molecule of the invention, which can be chemically modified, that can be used to modulate the expression of an HCV target gene in a biological system, including, for example, in a cell, tissue, or organism. In another embodiment, the invention features a kit containing more than one siNA molecule of the invention, which can be chemically modified, that can be used to modulate the expression of more than one HCV target gene in a biological system, including, for example, in a cell, tissue, or organism.

In one embodiment, the invention features a cell containing one or more siNA molecules of the invention, which can be chemically modified. In another embodiment, the cell containing an siNA molecule of the invention is a mammalian cell. In yet another embodiment, the cell containing an siNA molecule of the invention is a human cell.

In one embodiment, the synthesis of an siNA molecule of the invention, which can be chemically modified, comprises: (a) synthesis of two complementary strands of the siNA molecule; (b) annealing the two complementary strands together under conditions suitable to obtain a double-stranded siNA molecule. In another embodiment, synthesis of the two complementary strands of the siNA molecule is by solid phase oligonucleotide synthesis. In yet another embodiment, synthesis of the two complementary strands of the siNA molecule is by solid phase tandem oligonucleotide synthesis.

In one embodiment, the invention features a method for synthesizing an siNA duplex molecule comprising: (a) synthesizing a first oligonucleotide sequence strand of the siNA molecule, wherein the first oligonucleotide sequence strand comprises a cleavable linker molecule that can be used as a scaffold for the synthesis of the second oligonucleotide sequence strand of the siNA; (b) synthesizing the second oligonucleotide sequence strand of siNA on the scaffold of the first oligonucleotide sequence strand, wherein the second oligonucleotide sequence strand further comprises a chemical moiety than can be used to purify the siNA duplex; (c) cleaving the linker molecule of (a) under conditions suitable for the two siNA oligonucleotide strands to hybridize and form a stable duplex; and (d) purifying the siNA duplex utilizing the chemical moiety of the second oligonucleotide sequence strand. In one embodiment, cleavage of the linker molecule in (c) above takes place during deprotection of the oligonucleotide, for example under hydrolysis conditions using an alkylamine base such as methylamine. In one embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity as the solid support derivatized linker, such that cleavage of the solid support derivatized linker and the cleavable linker of (a) takes place concomitantly. In another embodiment, the chemical moiety of (b) that can be used to isolate the attached oligonucleotide sequence comprises a trityl group, for example a dimethoxytrityl group, which can be employed in a trityl-on synthesis strategy as described herein. In yet another embodiment, the chemical moiety, such as a dimethoxytrityl group, is removed during purification, for example, using acidic conditions.

In a further embodiment, the method for siNA synthesis is a solution phase synthesis or hybrid phase synthesis wherein both strands of the siNA duplex are synthesized in tandem using a cleavable linker attached to the first sequence which acts a scaffold for synthesis of the second sequence. Cleavage of the linker under conditions suitable for hybridization of the separate siNA sequence strands results in formation of the double-stranded siNA molecule.

In another embodiment, the invention features a method for synthesizing an siNA duplex molecule comprising: (a) synthesizing one oligonucleotide sequence strand of the siNA molecule, wherein the sequence comprises a cleavable linker molecule that can be used as a scaffold for the synthesis of another oligonucleotide sequence; (b) synthesizing a second oligonucleotide sequence having complementarity to the first sequence strand on the scaffold of (a), wherein the second sequence comprises the other strand of the double-stranded siNA molecule and wherein the second sequence further comprises a chemical moiety than can be used to isolate the attached oligonucleotide sequence; (c) purifying the product of (b) utilizing the chemical moiety of the second oligonucleotide sequence strand under conditions suitable for isolating the full-length sequence comprising both siNA oligonucleotide strands connected by the cleavable linker and under conditions suitable for the two siNA oligonucleotide strands to hybridize and form a stable duplex. In one embodiment, cleavage of the linker molecule in (c) above takes place during deprotection of the oligonucleotide, for example under hydrolysis conditions. In another embodiment, cleavage of the linker molecule in (c) above takes place after deprotection of the oligonucleotide. In another embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity or differing reactivity as the solid support derivatized linker, such that cleavage of the solid support derivatized linker and the cleavable linker of (a) takes place either concomitantly or sequentially. In one embodiment, the chemical moiety of (b) that can be used to isolate the attached oligonucleotide sequence comprises a trityl group, for example a dimethoxytrityl group.

In another embodiment, the invention features a method for making a double-stranded siNA molecule in a single synthetic process comprising: (a) synthesizing an oligonucleotide having a first and a second sequence, wherein the first sequence is complementary to the second sequence, and the first oligonucleotide sequence is linked to the second sequence via a cleavable linker, and wherein a terminal 5'-protecting group, for example, a 5'-O-dimethoxytrityl group (5'-O-DMT) remains on the oligonucleotide having the second sequence; (b) deprotecting the oligonucleotide whereby the deprotection results in the cleavage of the linker joining the two oligonucleotide sequences; and (c) purifying the product of (b) under conditions suitable for isolating the double-stranded siNA molecule, for example using a trityl-on synthesis strategy as described herein.

In another embodiment, the method of synthesis of siNA molecules of the invention comprises the teachings of Scaringe et al., U.S. Pat. Nos. 5,889,136; 6,008,400; and 6,111,086, incorporated by reference herein in their entirety.

In one embodiment, the invention features siNA constructs that mediate RNAi against an HCV, wherein the siNA construct comprises one or more chemical modifications, for example, one or more chemical modifications having any of Formulae I-VII or any combination thereof that increases the nuclease resistance of the siNA construct.

In another embodiment, the invention features a method for generating siNA molecules with increased nuclease resistance comprising (a) introducing nucleotides having any of Formula I-VII or any combination thereof into an siNA molecule, and (b) assaying the siNA molecule of step (a) under conditions suitable for isolating siNA molecules having increased nuclease resistance.

In one embodiment, the invention features siNA constructs that mediate RNAi against an HCV, wherein the siNA construct comprises one or more chemical modifications described herein that modulates the binding affinity between the sense and antisense strands of the siNA construct.

In another embodiment, the invention features a method for generating siNA molecules with increased binding affinity between the sense and antisense strands of the siNA molecule comprising (a) introducing nucleotides having any of Formula I-VII or any combination thereof into an siNA molecule, and (b) assaying the siNA molecule of step (a) under conditions suitable for isolating siNA molecules having increased binding affinity between the sense and antisense strands of the siNA molecule.

In one embodiment, the invention features siNA constructs that mediate RNAi against an HCV, wherein the siNA construct comprises one or more chemical modifications described herein that modulates the binding affinity between the antisense strand of the siNA construct and a complementary target RNA sequence within a cell.

In one embodiment, the invention features siNA constructs that mediate RNAi against an HCV, wherein the siNA construct comprises one or more chemical modifications described herein that modulates the binding affinity between the antisense strand of the siNA construct and a complementary target DNA sequence within a cell.

In another embodiment, the invention features a method for generating siNA molecules with increased binding affinity between the antisense strand of the siNA molecule and a complementary target RNA sequence comprising (a) introducing nucleotides having any of Formula I-VII or any combination thereof into an siNA molecule, and (b) assaying the siNA molecule of step (a) under conditions suitable for isolating siNA molecules having increased binding affinity between the antisense strand of the siNA molecule and a complementary target RNA sequence.

In another embodiment, the invention features a method for generating siNA molecules with increased binding affinity between the antisense strand of the siNA molecule and a complementary target DNA sequence comprising (a) introducing nucleotides having any of Formula I-VII or any combination thereof into an siNA molecule, and (b) assaying the siNA molecule of step (a) under conditions suitable for isolating siNA molecules having increased binding affinity between the antisense strand of the siNA molecule and a complementary target DNA sequence.

In one embodiment, the invention features siNA constructs that mediate RNAi against an HCV, wherein the siNA construct comprises one or more chemical modifications described herein that modulate the polymerase activity of a cellular polymerase capable of generating additional endogenous siNA molecules having sequence homology to the chemically modified siNA construct.

In another embodiment, the invention features a method for generating siNA molecules capable of mediating increased polymerase activity of a cellular polymerase capable of generating additional endogenous siNA molecules having sequence homology to a chemically modified siNA molecule comprising (a) introducing nucleotides having any of Formula I-VII or any combination thereof into an siNA molecule, and (b) assaying the siNA molecule of step (a) under conditions suitable for isolating siNA molecules capable of mediating increased polymerase activity of a cellular polymerase capable of generating additional endogenous siNA molecules having sequence homology to the chemically modified siNA molecule.

In one embodiment, the invention features chemically modified siNA constructs that mediate RNAi against an HCV in a cell, wherein the chemical modifications do not significantly effect the interaction of siNA with a target RNA molecule, DNA molecule and/or proteins or other factors that are essential for RNAi in a manner that would decrease the efficacy of RNAi mediated by such siNA constructs.

In another embodiment, the invention features a method for generating siNA molecules with improved RNAi activity against HCV comprising (a) introducing nucleotides having any of Formula I-VII or any combination thereof into an siNA molecule, and (b) assaying the siNA molecule of step (a) under conditions suitable for isolating siNA molecules having improved RNAi activity.

In yet another embodiment, the invention features a method for generating siNA molecules with improved RNAi activity against an HCV target RNA comprising (a) introducing nucleotides having any of Formula I-VII or any combination thereof into an siNA molecule, and (b) assaying the siNA molecule of step (a) under conditions suitable for isolating siNA molecules having improved RNAi activity against the target RNA.

In yet another embodiment, the invention features a method for generating siNA molecules with improved RNAi activity against an HCV target DNA comprising (a) introducing nucleotides having any of Formula I-VII or any combination thereof into an siNA molecule, and (b) assaying the siNA molecule of step (a) under conditions suitable for isolating siNA molecules having improved RNAi activity against the target DNA.

In one embodiment, the invention features siNA constructs that mediate RNAi against an HCV, wherein the siNA construct comprises one or more chemical modifications described herein that modulates the cellular uptake of the siNA construct.

In another embodiment, the invention features a method for generating siNA molecules against HCV with improved cellular uptake comprising (a) introducing nucleotides having any of Formula I-VII or any combination thereof into an siNA molecule, and (b) assaying the siNA molecule of step (a) under conditions suitable for isolating siNA molecules having improved cellular uptake.

In one embodiment, the invention features siNA constructs that mediate RNAi against an HCV, wherein the siNA construct comprises one or more chemical modifications described herein that increases the bioavailability of the siNA construct, for example, by attaching polymeric conjugates such as polyethyleneglycol or equivalent conjugates that improve the pharmacokinetics of the siNA construct, or by attaching conjugates that target specific tissue types or cell types in vivo. Non-limiting examples of such conjugates are described in Vargeese et al., U.S. Ser. No. 10/201,394 incorporated by reference herein.

In one embodiment, the invention features a method for generating siNA molecules of the invention with improved bioavailability, comprising (a) introducing a conjugate into the structure of an siNA molecule, and (b) assaying the siNA molecule of step (a) under conditions suitable for isolating siNA molecules having improved bioavailability. Such conjugates can include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; polyamines, such as spermine or spermidine; and others.

In another embodiment, the invention features a method for generating siNA molecules of the invention with improved bioavailability comprising (a) introducing an excipient formulation to an siNA molecule, and (b) assaying the siNA molecule of step (a) under conditions suitable for isolating siNA molecules having improved bioavailability. Such excipients include polymers such as cyclodextrins, lipids, cationic lipids, polyamines, phospholipids, nanoparticles, receptors, ligands, and others.

The term "ligand" refers to any compound or molecule, such as a drug, peptide, hormone, or neurotransmitter that is capable of interacting with another compound, such as a receptor, either directly or indirectly. The receptor that interacts with a ligand can be present on the surface of a cell or can alternately be an intercellular receptor. Interaction of the ligand with the receptor can result in a biochemical reaction, or can simply be a physical interaction or association.

In another embodiment, the invention features a method for generating siNA molecules of the invention with improved bioavailability comprising (a) introducing nucleotides having any of Formulae I-VII or any combination thereof into an siNA molecule, and (b) assaying the siNA molecule of step (a) under conditions suitable for isolating siNA molecules having improved bioavailability.

In another embodiment, polyethylene glycol (PEG) can be covalently attached to siNA compounds of the present invention. The attached PEG can be any molecular weight, preferably from about 2,000 to about 50,000 daltons (Da).

The present invention can be used alone or as a component of a kit having at least one of the reagents necessary to carry out the in vitro or in vivo introduction of RNA to test samples and/or subjects. For example, preferred components of the kit include an siNA molecule of the invention and a vehicle that promotes introduction of the siNA into cells of interest as described herein (e.g., using lipids and other methods of transfection known in the art, see for example Beigelman et al, U.S. Pat. No. 6,395,713). The kit can be used for target validation, such as in determining gene function and/or activity, or in drug optimization, and in drug discovery (see for example Usman et al., U.S. Ser. No. 60/402,996). Such a kit can also include instructions to allow a user of the kit to practice the invention.

The term "short interfering nucleic acid", "siNA", "short interfering RNA", "siRNA", "short interfering nucleic acid molecule", "short interfering oligonucleotide molecule", or "chemically modified short interfering nucleic acid molecule" as used herein refers to any nucleic acid molecule capable of inhibiting or down regulating gene expression or viral replication, for example by mediating RNA interference "RNAi" or gene silencing in a sequence-specific manner; see for example Bass, 2001, *Nature*, 411, 428-429; Elbashir et al., 2001, *Nature*, 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237; Hutvagner and Zamore, 2002, *Science*, 297, 2056-60; McManus et al., 2002, *RNA*, 8, 842-850; Reinhart et al., 2002, *Gene & Dev.*, 16, 1616-1626; and Reinhart & Bartel, 2002, *Science*, 297, 1831). Non limiting examples of siNA molecules of the invention are shown in FIGS. 4-6, and Tables II, III, and IV herein. For example the siNA can be a double-stranded polynucleotide molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The siNA can be assembled from two separate oligonucleotides, where one strand is the sense strand and the other is the antisense strand, wherein the antisense and sense strands are self-complementary (i.e. each strand comprises nucleotide sequence that is complementary to nucleotide sequence in the other strand; such as where the antisense strand and sense strand form a duplex or double-stranded structure, for example wherein the double-stranded region is about 19 base pairs); the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof. Alternatively, the siNA is assembled from a single oligonucleotide, where the self-complementary sense and antisense regions of the siNA are linked by means of a nucleic acid based or non-nucleic acid-based linker(s). The siNA can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single stranded polynucleotide having nucleotide sequence complementary to nucleotide sequence in a target nucleic acid molecule or a portion thereof (for example, where such siNA molecule does not require the presence within the siNA molecule of a nucleotide sequence corresponding to the target nucleic acid sequence or a portion thereof), wherein the single stranded polynucleotide can further comprise a terminal phosphate group, such as a 5'-phosphate (see for example Martinez et al., 2002, *Cell.*, 110, 563-574 and Schwarz et al., 2002, *Molecular Cell*, 10, 537-568), or 5',3'-diphosphate. In certain embodiment, the siNA molecule of the invention comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the siNA molecules of the invention comprise a nucleotide sequence that is complementary to nucleotide sequence of a target gene. In another embodiment, the siNA molecule of the invention interacts with nucleotide sequence of a target gene in a manner that causes inhibition of expression of the target gene. As used herein, siNA molecules need not be limited to those molecules containing only RNA, but further encompasses chemically modified nucleotides and non-nucleotides. In certain embodiments, the short interfering nucleic acid molecules of the invention lack 2'-hydroxy (2'-OH) containing nucleotides. Applicant describes in certain embodiments short interfering nucleic acids that do not require the presence of nucleotides having a 2'-hydroxy group for mediating RNAi and as such, short interfering nucleic acid molecules of the invention optionally do not include any ribonucleotides (e.g., nucleotides having a 2'-OH group). Such siNA molecules that do not require the presence of ribonucleotides within the siNA molecule to support RNAi can however have an attached linker or linkers or other attached or associated groups, moieties, or chains containing one or more nucleotides with 2'-OH groups. Optionally, siNA molecules can comprise ribonucleotides at about 5, 10, 20, 30, 40, or 50% of the nucleotide positions. The modified short interfering nucleic acid molecules of the invention can also be referred to as short interfering modified oligonucleotides "siMON." As used herein, the term siNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition or epigenetics. For example, siNA molecules of the invention can be used to epigenetically silence genes at the post-transcriptional level or the pre-transcriptional level. In a non-limiting example, epigenetic regulation of gene expression by siNA molecules of the invention can result from siNA mediated modification of chromatin structure to alter gene expression (see, for example, Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237).

By "asymmetric hairpin" as used herein is meant a linear siNA molecule comprising an antisense region, a loop portion that can comprise nucleotides or non-nucleotides, and a sense region that comprises fewer nucleotides than the antisense region to the extent that the sense region has enough complementary nucleotides to base pair with the antisense region and form a duplex with loop. For example, an asymmetric hairpin siNA molecule of the invention can comprise an antisense region having length sufficient to mediate RNAi in a cell or in vitro system (e.g. about 19 to about 22 (e.g., about 19, 20, 21, or 22) nucleotides) and a loop region comprising about 4 to about 8 (e.g., about 4, 5, 6, 7, or 8) nucleotides, and a sense region having about 3 to about 18 (e.g., about 3, 4, 5, 6, 7, 8, 9, 10, 11, 12, 13, 14, 15, 16, 17, or 18) nucleotides that are complementary to the antisense region. The asymmetric hairpin siNA molecule can also comprise a 5'-terminal phosphate group that can be chemically modified. The loop portion of the asymmetric hairpin siNA molecule can comprise nucleotides, non-nucleotides, linker molecules, or conjugate molecules as described herein.

By "asymmetric duplex" as used herein is meant an siNA molecule having two separate strands comprising a sense region and an antisense region, wherein the sense region comprises fewer nucleotides than the antisense region to the extent that the sense region has enough complementary nucleotides to base pair with the antisense region and form a duplex. For example, an asymmetric duplex siNA molecule of the invention can comprise an antisense region having length sufficient to mediate RNAi in a cell or in vitro system (e.g. about 19 to about 22 (e.g. about 19, 20, 21, or 22) nucleotides) and a sense region having about 3 to about 18 (e.g., about 3, 4, 5, 6, 7, 8, 9, 10, 11, 12, 13, 14, 15, 16, 17, or 18) nucleotides that are complementary to the antisense region.

By "modulate" is meant that the expression of the gene, or level of RNA molecule or equivalent RNA molecules encoding one or more proteins or protein subunits, or activity of one or more proteins or protein subunits is up regulated or down regulated, such that expression, level, or activity is greater than or less than that observed in the absence of the modulator. For example, the term "modulate" can mean "inhibit," but the use of the word "modulate" is not limited to this definition.

By "inhibit", "down-regulate", or "reduce", it is meant that the expression of a gene, or level of RNA molecules or equivalent RNA molecules encoding one or more gene products, or activity of one or more gene products, is reduced below that observed in the absence of the nucleic acid molecules (e.g., siNA) of the invention. In one embodiment, inhibition, down-regulation or reduction with an siNA molecule is below that level observed in the presence of an inactive or attenuated molecule that is unable to mediate an RNAi response. In another embodiment, inhibition, down-regulation, or reduction with an siNA molecule is below that level observed in the presence of, for example, an siNA molecule with scrambled sequence or with mismatches. In another embodiment, inhibition, down-regulation, or reduction of gene expression with an siNA molecule of the instant invention is greater in the presence of the siNA molecule than in its absence.

By "gene" or "target gene" is meant, a nucleic acid that encodes an RNA, for example, nucleic acid sequences including, but not limited to, structural genes encoding a polypeptide. The target gene can be a gene derived from a cell, an endogenous gene, a transgene, or exogenous genes such as genes of a pathogen, for example a virus, which is present in the cell after infection thereof. The cell containing the target gene can be derived from or contained in any organism, for example a plant, animal, protozoan, virus, bacterium, or fungus. Non-limiting examples of plants include monocots, dicots, or gymnosperms. Non-limiting examples of animals include vertebrates or invertebrates. Non-limiting examples of fungi include molds or yeasts.

By "HCV" as used herein is meant the hepatitis C virus or any protein, peptide, or polypeptide, having hepatitis C virus activity or encoded by the HCV genome. The term "HCV" also includes nucleic acid molecules encoding RNA or protein(s) associated with the development and/or maintenance of HCV infection, such as nucleic acid molecules which encode HCV RNA or polypeptides (such as polynucleotides having Genbank Accession numbers shown in Table I), including polypeptides of different strains of HCV, mutant HCV genes, and splice variants of HCV genes, as well as genes involved in HCV pathways of gene expression and/or HCV activity. Also, the term "HCV" is meant to encompass HCV viral gene products and genes that modulate cellular targets for HCV infection, such as those described herein.

By "HCV protein" is meant, protein, peptide, or polypeptide, having hepatitis C virus activity or encoded by the HCV genome.

By "highly conserved sequence region" is meant, a nucleotide sequence of one or more regions in a target gene does not vary significantly from one generation to the other or from one biological system to the other.

By "sense region" is meant a nucleotide sequence of an siNA molecule having complementarity to an antisense region of the siNA molecule. In addition, the sense region of an siNA molecule can comprise a nucleic acid sequence having homology with a target nucleic acid sequence.

By "antisense region" is meant a nucleotide sequence of an siNA molecule having complementarity to a target nucleic acid sequence. In addition, the antisense region of an siNA molecule can optionally comprise a nucleic acid sequence having complementarity to a sense region of the siNA molecule.

By "target nucleic acid" is meant any nucleic acid sequence whose expression or activity is to be modulated. The target nucleic acid can be DNA or RNA.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, *CSH Symp. Quant. Biol.* LII pp. 123-133; Frier et al., 1986, *Proc. Nat. Acad. Sci. USA* 83:9373-9377; Turner et al., 1987, *J. Am. Chem. Soc.* 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence.

The siNA molecules of the invention represent a novel therapeutic approach to treat various diseases and conditions, including HCV infection, liver failure, hepatocellular carcinoma, cirrhosis and any other indications that can respond to the level of HCV in a cell or tissue.

In one embodiment of the present invention, each sequence of an siNA molecule of the invention is independently about 18 to about 24 nucleotides in length, in specific embodiments about 18, 19, 20, 21, 22, 23, or 24 nucleotides in length. In another embodiment, the siNA duplexes of the invention independently comprise about 17 to about 23 base pairs (e.g., about 17, 18, 19, 20, 21, 22 or 23). In yet another embodiment, siNA molecules of the invention comprising hairpin or circular structures are about 35 to about 55 (e.g., about 35, 40, 45, 50 or 55) nucleotides in length, or about 38 to about 44 (e.g., 38, 39, 40, 41, 42, 43 or 44) nucleotides in length and comprising about 16 to about 22 (e.g., about 16, 17, 18, 19, 20, 21 or 22) base pairs. Exemplary siNA molecules of the invention are shown in Table II. Exemplary synthetic siNA molecules of the invention are shown in Tables III and IV and/or FIGS. 4-5.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell.

The siNA molecules of the invention are added directly, or can be complexed with cationic lipids, packaged within liposomes, or otherwise delivered to target cells or tissues. The nucleic acid or nucleic acid complexes can be locally administered to relevant tissues ex vivo, or in vivo through injection, infusion pump or stent, with or without their incorporation in biopolymers. In particular embodiments, the nucleic acid molecules of the invention comprise sequences shown in Tables II-III and/or FIGS. 4-5. Examples of such nucleic acid molecules consist essentially of sequences defined in these tables and figures. Furthermore, the chemically modified constructs described in Table IV can be applied to any siNA sequence of the invention.

In another aspect, the invention provides mammalian cells containing one or more siNA molecules of this invention. The one or more siNA molecules can independently be targeted to the same or different sites.

By "RNA" is meant a molecule comprising at least one ribonucleotide residue. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the siNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the nucleic acid molecules of the invention can be administered. A subject can be a mammal or mammalian cells, including a human or human cells.

The term "phosphorothioate" as used herein refers to an internucleotide linkage having Formula I, wherein Z and/or W comprise a sulfur atom. Hence, the term phosphorothioate refers to both phosphorothioate and phosphorodithioate internucleotide linkages.

The term "phosphonoacetate" as used herein refers to an internucleotide linkage having Formula I, wherein Z and/or W comprise an acetyl or protected acetyl group.

The term "thiophosphonoacetate" as used herein refers to an internucleotide linkage having Formula I, wherein Z comprises an acetyl or protected acetyl group and W comprises a sulfur atom or alternately W comprises an acetyl or protected acetyl group and Z comprises a sulfur atom.

The term "universal base" as used herein refers to nucleotide base analogs that form base pairs with each of the natural DNA/RNA bases with little discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art (see for example Loakes, 2001, *Nucleic Acids Research*, 29, 2437-2447).

The term "acyclic nucleotide" as used herein refers to any nucleotide having an acyclic ribose sugar.

The nucleic acid molecules of the instant invention, individually, or in combination or in conjunction with other drugs, can be used to treat diseases or conditions discussed herein, e.g., an siRNA molecule of the invention can be adapted for use to treat for example HCV infection, liver failure, hepatocellular carcinoma, cirrhosis and other indications that can respond to the level of HCV in a cell or tissue. For example, to treat a particular disease or condition, the siNA molecules can be administered to a subject or can be administered to other appropriate cells evident to those skilled in the art, individually or in combination with one or more drugs under conditions suitable for the treatment.

In a further embodiment, the siNA molecules can be used in combination with other known treatments to treat conditions or diseases discussed above. For example, the described molecules can be used in combination with one or more known therapeutic agents to treat a disease or condition. Non-limiting examples of other therapeutic agents that can be readily combined with an siNA molecule of the invention are enzymatic nucleic acid molecules, allosteric nucleic acid molecules, antisense, decoy, or aptamer nucleic acid molecules, antibodies such as monoclonal antibodies, small molecules, and other organic and/or inorganic compounds including metals, salts and ions.

In one embodiment, the invention features an expression vector comprising a nucleic acid sequence encoding at least one siNA molecule of the invention, in a manner which allows expression of the siNA molecule. For example, the vector can contain sequence(s) encoding both strands of an siNA molecule comprising a duplex. The vector can also contain sequence(s) encoding a single nucleic acid molecule that is self-complementary and thus forms an siNA molecule. Non-limiting examples of such expression vectors are described in Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi:10.1038/nm725.

In another embodiment, the invention features a mammalian cell, for example, a human cell, including an expression vector of the invention.

In yet another embodiment, the expression vector of the invention comprises a sequence for an siNA molecule having complementarity to a RNA molecule referred to by a Genbank Accession numbers, for example Genbank Accession Nos. shown in Table I.

In one embodiment, an expression vector of the invention comprises a nucleic acid sequence encoding two or more siNA molecules, which can be the same or different.

In another aspect of the invention, siNA molecules that interact with target RNA molecules and down-regulate gene encoding target RNA molecules (for example target RNA molecules referred to by Genbank Accession numbers herein) are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules. Such vectors can be repeatedly administered as necessary. Once expressed, the siNA molecules bind and down-regulate gene function or expression via RNA interference (RNAi). Delivery of siNA expressing vectors can be systemic, such as by intravenous or intramuscular administration, by administration to target cells ex-planted from a subject followed by reintroduction into the subject, or by any other means that would allow for introduction into the desired target cell.

By "vectors" is meant any nucleic acid- and/or viral-based technique used to deliver a desired nucleic acid.

Other features and advantages of the invention will be apparent from the following description of the preferred embodiments thereof, and from the claims.

BRIEF DESCRIPTION OF THE DRAWINGS

FIG. 1 shows a non-limiting example of a scheme for the synthesis of siNA molecules. The complementary siNA sequence strands, strand 1 and strand 2, are synthesized in tandem and are connected by a cleavable linkage, such as a nucleotide succinate or abasic succinate, which can be the same or different from the cleavable linker used for solid phase synthesis on a solid support. The synthesis can be either solid phase or solution phase, in the example shown, the synthesis is a solid phase synthesis. The synthesis is performed such that a protecting group, such as a dimethoxytrityl group, remains intact on the terminal nucleotide of the tandem oligonucleotide. Upon cleavage and deprotection of the oligonucleotide, the two siNA strands spontaneously hybridize to form an siNA duplex, which allows the purification of the duplex by utilizing the properties of the terminal protecting group, for example by applying a trityl on purification method wherein only duplexes/oligonucleotides with the terminal protecting group are isolated.

FIG. 4A-F shows non-limiting examples of chemically modified siNA constructs of the present invention. In the figure, N stands for any nucleotide (adenosine, guanosine, cytosine, uridine, or optionally thymidine, for example thymidine can be substituted in the overhanging regions designated by parenthesis (N N). Various modifications are shown for the sense and antisense strands of the siNA constructs. The antisense strand of constructs A-F comprise sequence complementary to any target nucleic acid sequence of the invention. Furthermore, when a glyceryl moiety (L) is present at the 3'-end of the antisense strand for any construct shown in FIG. 4 A-F, the modified internucleotide linkage is optional.

FIG. 4A: The sense strand comprises 21 nucleotides wherein the two terminal 3'-nucleotides are optionally base paired and wherein all nucleotides present are ribonucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all nucleotides present are ribonucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s" connects the (N N) nucleotides in the antisense strand.

FIG. 4B: The sense strand comprises 21 nucleotides wherein the two terminal 3'-nucleotides are optionally base paired and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s" connects the (N N) nucleotides in the sense and antisense strand.

FIG. 4C: The sense strand comprises 21 nucleotides having 5'- and 3'-terminal cap moieties wherein the two terminal 3'-nucleotides are optionally base paired and wherein all pyrimidine nucleotides that may be present are 2'-O-methyl or 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s" connects the (N N) nucleotides in the antisense strand.

FIG. 4D: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s" connects the (N N) nucleotides in the antisense strand.

FIG. 4E: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s" connects the (N N) nucleotides in the antisense strand.

FIG. 4F: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, and having one 3'-terminal phosphorothioate internucleotide linkage and wherein all pyrimidine nucleotides that may be present are 2'-deoxy-2'-fluoro modified nucleotides and all purine nucleotides that may be present are 2'-deoxy nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s" connects the (N N) nucleotides in the antisense strand.

In another example, construct 3 can be used to generate construct 2 under the same principle wherein a linker is used to generate the active siNA construct 2 in vivo and/or in vitro, which can optionally utilize another biodegradable linker to generate the active siNA construct 1 in vivo and/or in vitro. As such, the stability and/or activity of the siNA constructs can be modulated based on the design of the siNA construct for use in vivo or in vitro and/or in vitro.

Figure 7:
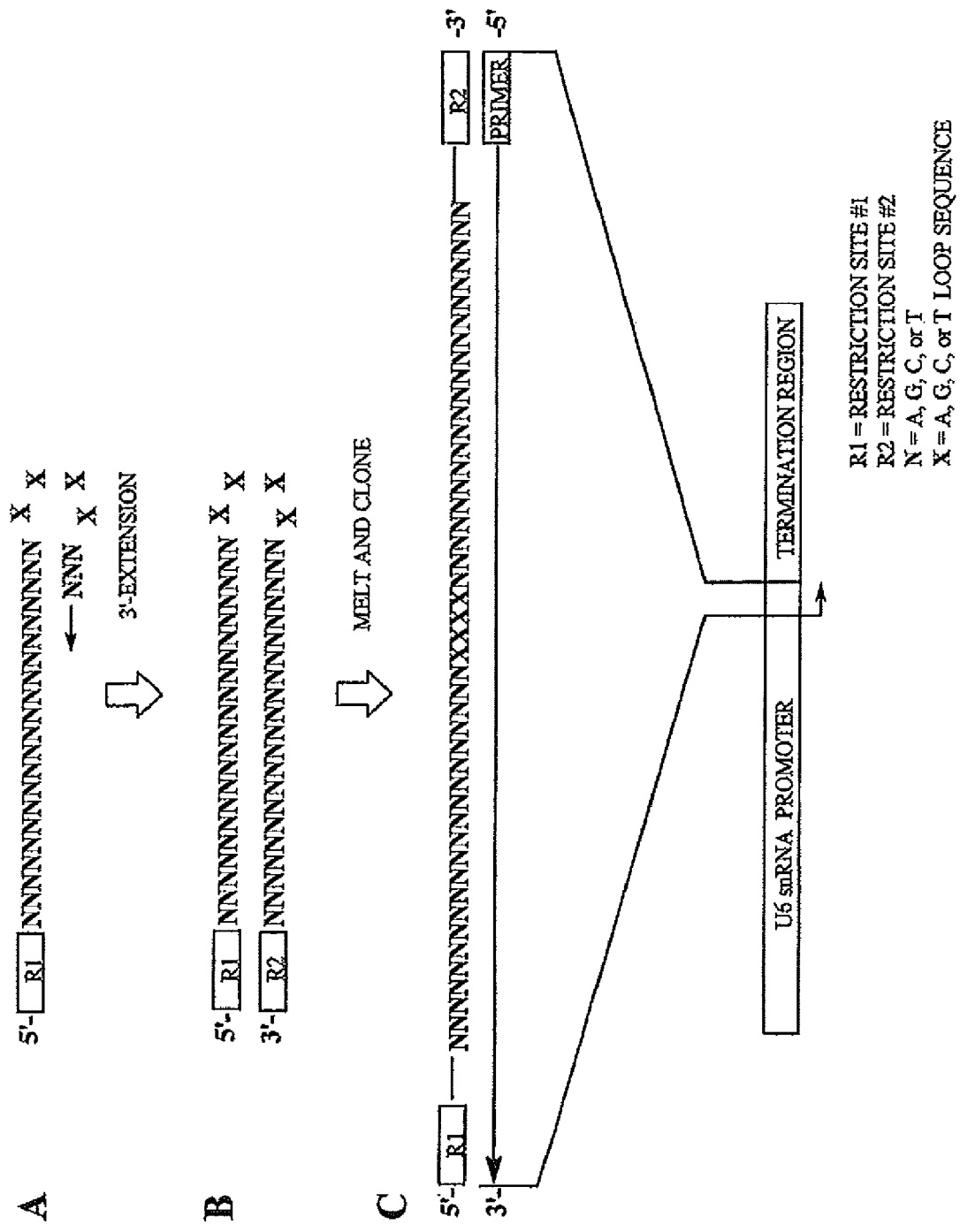

FIG. 7A-C is a diagrammatic representation of a scheme utilized in generating an expression cassette to generate siNA hairpin constructs.

FIG. 7A: A DNA oligomer is synthesized with a 5'-restriction site (R1) sequence followed by a region having sequence identical (sense region of siNA) to a predetermined HCV target sequence, wherein the sense region comprises, for example, about 19, 20, 21, or 22 nucleotides (N) in length, which is followed by a loop sequence of defined sequence (X), comprising, for example, about 3 to about 10 nucleotides.

FIG. 7B: The synthetic construct is then extended by DNA polymerase to generate a hairpin structure having self-complementary sequence that will result in an siNA transcript having specificity for an HCV target sequence and having self-complementary sense and antisense regions.

FIG. 7C: The construct is heated (for example to about 95° C.) to linearize the sequence, thus allowing extension of a complementary second DNA strand using a primer to the 3'-restriction sequence of the first strand. The double-stranded DNA is then inserted into an appropriate vector for expression in cells. The construct can be designed such that a 3'-terminal nucleotide overhang results from the transcription, for example by engineering restriction sites and/or utilizing a poly-U termination region as described in Paul et al., 2002, *Nature Biotechnology*, 29, 505-508.

Figure 8:
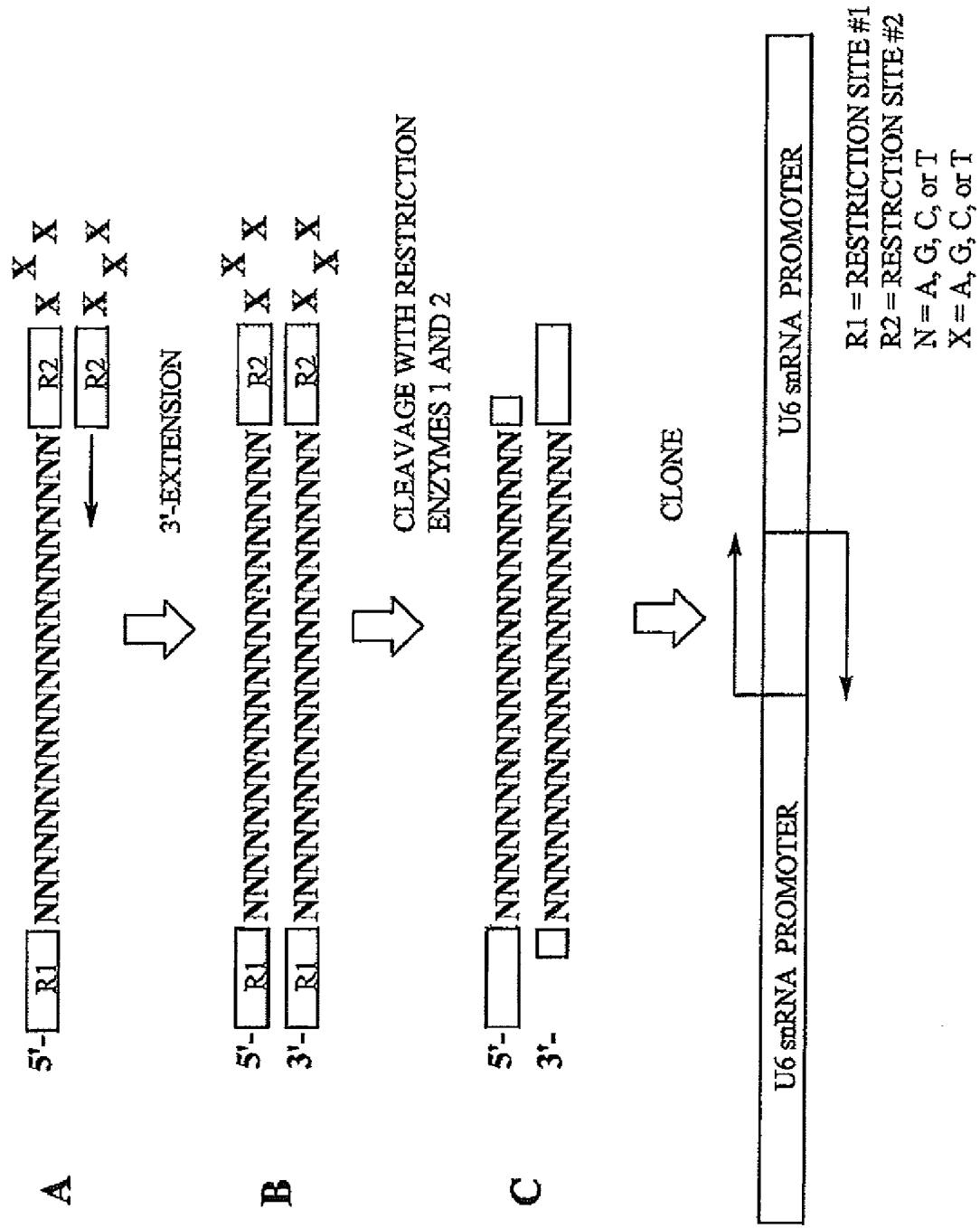

FIG. 8A-C is a diagrammatic representation of a scheme utilized in generating an expression cassette to generate double-stranded siNA constructs.

FIG. 8A: A DNA oligomer is synthesized with a 5'-restriction (R1) site sequence followed by a region having sequence identical (sense region of siNA) to a predetermined HCV target sequence, wherein the sense region comprises, for example, about 19, 20, 21, or 22 nucleotides (N) in length, and which is followed by a 3'-restriction site (R2) which is adjacent to a loop sequence of defined sequence (X).

FIG. 8B: The synthetic construct is then extended by DNA polymerase to generate a hairpin structure having self-complementary sequence.

FIG. 8C: The construct is processed by restriction enzymes specific to R1 and R2 to generate a double-stranded DNA which is then inserted into an appropriate vector for expression in cells. The transcription cassette is designed such that a U6 promoter region flanks each side of the dsDNA which generates the separate sense and antisense strands of the siNA. Poly T termination sequences can be added to the constructs to generate U overhangs in the resulting transcript.

FIG. 9A-E is a diagrammatic representation of a method used to determine target sites for siNA mediated RNAi within a particular target nucleic acid sequence, such as messenger RNA.

FIG. 9A: A pool of siNA oligonucleotides are synthesized wherein the antisense region of the siNA constructs has complementarity to target sites across the target nucleic acid sequence, and wherein the sense region comprises sequence complementary to the antisense region of the siNA.

FIGS. 9B&C: (FIG. 9B) The sequences are pooled and are inserted into vectors such that (FIG. 9C) transfection of a vector into cells results in the expression of the siNA.

FIG. 9D: Cells are sorted based on phenotypic change that is associated with modulation of the target nucleic acid sequence.

FIG. 9E: The siNA is isolated from the sorted cells and is sequenced to identify efficacious target sites within the target nucleic acid sequence.

Figure 10:
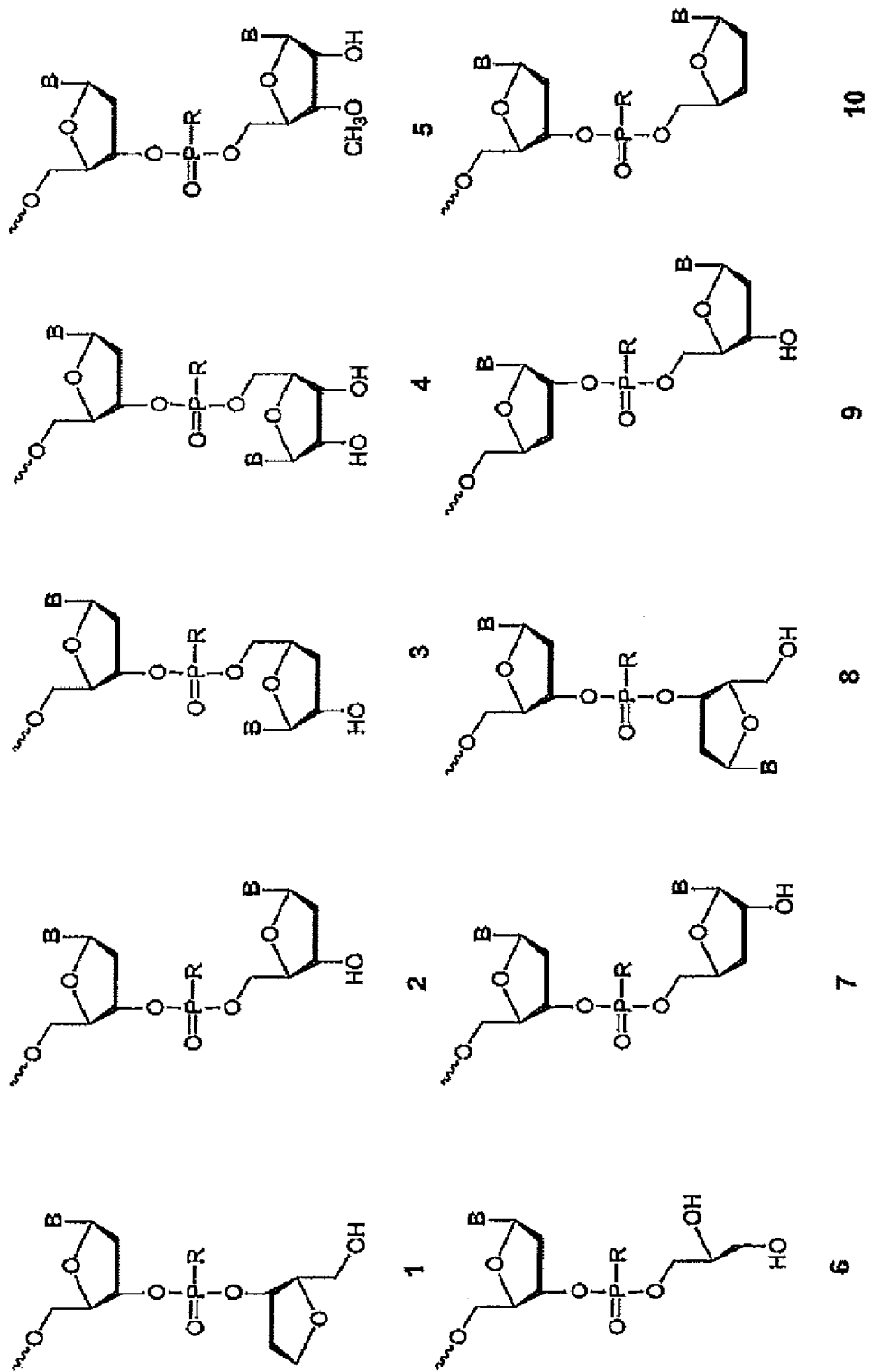

FIG. 10 shows non-limiting examples of different stabilization chemistries (1-10) that can be used, for example, to stabilize the 3'-end of siNA sequences of the invention, including (1) [3-3']-inverted deoxyribose; (2) deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3'-5']-3'-deoxyribonucleotide; (8) [3'-3']-deoxyribonucleotide; (9) [5'-2']-deoxyribonucleotide; and (10) [5-3']-dideoxyribonucleotide. In addition to modified and unmodified backbone chemistries indicated in the figure, these chemistries can be combined with different backbone modifications as described herein, for example, backbone modifications having Formula I. In addition, the 2'-deoxy nucleotide shown 5' to the terminal modifications shown can be another modified or unmodified nucleotide or non-nucleotide described herein, for example modifications having any of Formulae I-VII or any combination thereof.

FIG. 11 shows a non-limiting example of a strategy used to identify chemically modified siNA constructs of the invention that are nuclease resistance while preserving the ability to mediate RNAi activity. Chemical modifications are introduced into the siNA construct based on educated design parameters (e.g. introducing 2'-modifications, base modifications, backbone modifications, terminal cap modifications etc). The modified construct is tested in an appropriate system (e.g. human serum for nuclease resistance, shown, or an animal model for PK/delivery parameters). In parallel, the siNA construct is tested for RNAi activity, for example, in a cell culture system such as a luciferase reporter assay. Lead siNA constructs are then identified which possess a particular characteristic while maintaining RNAi activity, and can be further modified and assayed once again. This same approach can be used to identify siNA-conjugate molecules with improved pharmacokinetic profiles, delivery, and RNAi activity.

FIG. 12 shows a non-limiting example of siRNA constructs 29579/29586 and 29578/29585 targeting viral replication of an HCV/poliovirus chimera in comparison to an inverse siNA control construct 29593/29600.

FIG. 13 shows a non-limiting example of a dose response study of an siRNA construct 29579/29586 targeting viral replication of an HCV/poliovirus chimera in comparison to an inverse siNA control construct 29593/29600. The inhibition of HCV/poliovirus chimera replication by 29579/29586 siNA construct was measured at 1 nM, 5 nM, 10 nM, and 25 nM concentrations of 29579/29586 siNA construct.

FIG. 14 shows a non-limiting example of a chemically modified siNA construct 30051/30053 targeting viral replication of an HCV/poliovirus chimera in comparison to an inverse siNA control construct 30052/30054.

FIG. 15 shows a non-limiting example of a chemically modified siNA construct 30055/30057 targeting viral replication of an HCV/poliovirus chimera in comparison to an inverse siNA control construct 30056/30058.

FIG. 16 shows a non-limiting example of several chemically modified siRNA constructs targeting viral replication of an HCV/poliovirus chimera at 10 nM treatment in comparison to a lipid control and an inverse-siNA control construct 29593/29600.

FIG. 17 shows a non-limiting example of several chemically modified siRNA constructs targeting viral replication of an HCV/poliovirus chimera at 25 nM treatment in comparison to a lipid control and an inverse siNA control construct 29593/29600.

FIG. 18 shows a non-limiting example of several chemically modified siRNA constructs targeting viral replication of a Huh7 HCV replicon system at 25 nM treatment in comparison to untreated cells ("cells"), cells transfected with lipofectamine ("LFA2K") and inverse siNA control constructs.

FIG. 19 shows a non-limiting example of a dose response study using chemically modified siNA molecules (Stab 4/5, see Table IV) targeting HCV RNA sites 291, 300, and 303 in a Huh7 HCV replicon system at 5, 10, 25, and 100 nM treatment in comparison to untreated cells ("cells"), cells transfected with lipofectamine ("LFA") and inverse siNA control constructs.

FIG. 20 shows a non-limiting example of several chemically modified siNA constructs (Stab 7/8, see Table IV) targeting viral replication in a Huh7 HCV replicon system at 25 nM treatment in comparison to untreated cells ("cells"), cells transfected with lipofectamine ("Lipid") and inverse siNA control constructs.

FIG. 21 shows a non-limiting example of a dose response study using chemically modified siNA molecules (Stab 7/8, see Table IV) targeting HCV site 327 in a Huh7 HCV replicon system at 5, 10, 25, 50, and 100 nM treatment in comparison to inverse siNA control constructs.

FIG. 22 shows the results of a study in which siNA/interferon combination treatments were assayed using 0-100 nM siNA in an HCV Subgenomic Replicon system in Huh7 cells compared to interferon alone.

FIG. 23 shows non-limiting examples of phosphorylated siNA molecules of the invention, including linear and duplex constructs and asymmetric derivatives thereof.

FIG. 24 shows non-limiting examples of chemically modified terminal phosphate groups of the invention.

DETAILED DESCRIPTION OF THE INVENTION

Mechanism of Action of Nucleic Acid Molecules of the Invention

The discussion that follows discusses the proposed mechanism of RNA interference mediated by short interfering RNA as is presently known, and is not meant to be limiting and is not an admission of prior art. Applicant demonstrates herein that chemically modified short interfering nucleic acids possess similar or improved capacity to mediate RNAi as do siRNA molecules and are expected to possess improved stability and activity in vivo; therefore, this discussion is not meant to be limiting only to siRNA and can be applied to siNA as a whole. By "improved capacity to mediate RNAi" or "improved RNAi activity" is meant to include RNAi activity measured in vitro and/or in vivo where the RNAi activity is a reflection of both the ability of the siNA to mediate RNAi and the stability of the siNAs of the invention. In this invention, the product of these activities can be increased in vitro and/or in vivo compared to an all RNA siRNA or an siNA containing a plurality of ribonucleotides. In some cases, the activity or stability of the siNA molecule can be decreased (i.e., less than ten-fold), but the overall activity of the siNA molecule is enhanced in vitro and/or in vivo.

RNA interference refers to the process of sequence specific post-transcriptional gene silencing in animals mediated by short interfering RNAs (siRNAs) (Fire et al., 1998, Nature, 391, 806). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes which is commonly shared by diverse flora and phyla (Fire et al., 1999, Trends Genet., 15, 358). Such protection from foreign gene expression may have evolved in response to the production of double-stranded RNAs (dsRNAs) derived from viral infection or the random integration of transposon elements into a host genome via a cellular response that specifically destroys homologous single-stranded RNA or viral genomic RNA. The presence of dsRNA in cells triggers the RNAi response though a mechanism that has yet to be fully characterized. This mechanism appears to be different from the interferon response that results from dsRNA-mediated activation of protein kinase PKR and 2',5'-oligoadenylate synthetase resulting in non-specific cleavage of mRNA by ribonuclease L.

The presence of long dsRNAs in cells stimulates the activity of a ribonuclease III enzyme referred to as Dicer. Dicer is involved in the processing of the dsRNA into short pieces of dsRNA known as short interfering RNAs (siRNAs) (Berstein et al., 2001, Nature, 409, 363). Short interfering RNAs derived from Dicer activity are typically about 21 to about 23 nucleotides in length and comprise about 19 base pair duplexes. Dicer has also been implicated in the excision of 21- and 22-nucleotide small temporal RNAs (stRNAs) from precursor RNA of conserved structure that are implicated in translational control (Hutvagner et al., 2001, Science, 293, 834). The RNAi response also features an endonuclease complex containing an siRNA, commonly referred to as an RNA-induced silencing complex (RISC), which mediates cleavage of single-stranded RNA having sequence homologous to the siRNA. Cleavage of the target RNA takes place in the middle of the region complementary to the guide sequence of the siRNA duplex (Elbashir et al., 2001, Genes Dev., 15, 188). In addition, RNA interference can also involve small RNA (e.g., micro-RNA or miRNA) mediated gene silencing, presumably though cellular mechanisms that regulate chromatin structure and thereby prevent transcription of target gene sequences (see for example Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237). As such, siNA molecules of the invention can be used to mediate gene silencing via interaction with RNA transcripts or alternately by interaction with particular gene sequences, wherein such interaction results in gene silencing either at the transcriptional level or post-transcriptional level.

RNAi has been studied in a variety of systems. Fire et al., 1998, Nature, 391, 806, were the first to observe RNAi in C. elegans. Wianny and Goetz, 1999, Nature Cell Biol., 2, 70, describe RNAi mediated by dsRNA in mouse embryos. Hammond et al., 2000, Nature, 404, 293, describe RNAi in Drosophila cells transfected with dsRNA. Elbashir et al., 2001, Nature, 411, 494, describe RNAi induced by introduction of duplexes of synthetic 21-nucleotide RNAs in cultured mammalian cells including human embryonic kidney and HeLa cells. Recent work in Drosophila embryonic lysates has revealed certain requirements for siRNA length, structure, chemical composition, and sequence that are essential to mediate efficient RNAi activity. These studies have shown that 21 nucleotide siRNA duplexes are most active when containing two 2-nucleotide 3'-terminal nucleotide overhangs. Furthermore, substitution of one or both siRNA strands with 2'-deoxy or 2'-O-methyl nucleotides abolishes RNAi activity, whereas substitution of 3'-terminal siRNA nucleotides with deoxy nucleotides was shown to be tolerated. Mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end (Elbashir et al., 2001, *EMBO J.,* 20, 6877). Other studies have indicated that a 5'-phosphate on the target-complementary strand of an siRNA duplex is required for siRNA activity and that ATP is utilized to maintain the 5'-phosphate moiety on the siRNA (Nykanen et al., 2001, *Cell,* 107, 309); however, siRNA molecules lacking a 5'-phosphate are active when introduced exogenously, suggesting that 5'-phosphorylation of siRNA constructs may occur in vivo.

Synthesis of Nucleic Acid Molecules

Synthesis of nucleic acids greater than 100 nucleotides in length is difficult using automated methods, and the therapeutic cost of such molecules is prohibitive. In this invention, small nucleic acid motifs ("small" refers to nucleic acid motifs no more than 100 nucleotides in length, preferably no more than 80 nucleotides in length, and most preferably no more than 50 nucleotides in length; e.g., individual siNA oligonucleotide sequences or siNA sequences synthesized in tandem) are preferably used for exogenous delivery. The simple structure of these molecules increases the ability of the nucleic acid to invade targeted regions of protein and/or RNA structure. Exemplary molecules of the instant invention are chemically synthesized, and others can similarly be synthesized.

Oligonucleotides (e.g., certain modified oligonucleotides or portions of oligonucleotides lacking ribonucleotides) are synthesized using protocols known in the art, for example as described in Caruthers et al., 1992, *Methods in Enzymology* 211, 3-19, Thompson et al., International PCT Publication No. WO 99/54459, Wincott et al., 1995, *Nucleic Acids Res.* 23, 2677-2684, Wincott et al., 1997, *Methods Mol. Bio.,* 74, 59, Brennan et al., 1998, *Biotechnol Bioeng.,* 61, 33-45, and Brennan, U.S. Pat. No. 6,001,311. All of these references are incorporated herein by reference. The synthesis of oligonucleotides makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 μmol scale protocol with a 2.5 min coupling step for 2'-O-methylated nucleotides and a 45 second coupling step for 2'-deoxy nucleotides or 2'-deoxy-2'-fluoro nucleotides. Table V outlines the amounts and the contact times of the reagents used in the synthesis cycle. Alternatively, syntheses at the 0.2 μmol scale can be performed on a 96-well plate synthesizer, such as the instrument produced by Protogene (Palo Alto, Calif.) with minimal modification to the cycle. A 33-fold excess (60 μL of 0.11 M=6.6 μmol) of 2'-O-methyl phosphoramidite and a 105-fold excess of S-ethyl tetrazole (60 μL of 0.25 M=15 μmol) can be used in each coupling cycle of 2'-O-methyl residues relative to polymer-bound 5'-hydroxyl. A 22-fold excess (40 μL of 0.11 M=4.4 μmol) of deoxy phosphoramidite and a 70-fold excess of S-ethyl tetrazole (40 μL of 0.25 M=10 μmol) can be used in each coupling cycle of deoxy residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/ 10% 2,6-lutidine in THF (ABI); and oxidation solution is 16.9 mM $I_2$, 49 mM pyridine, 9% water in THF (PERSEPTIVE™). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-benzodithiol-3-one 1,1-dioxide, 0.05 M in acetonitrile) is used.

Deprotection of the DNA-based oligonucleotides is performed as follows: the polymer-bound trityl-on oligoribonucleotide is transferred to a 4 mL glass screw top vial and suspended in a solution of 40% aqueous methylamine (1 mL) at 65° C. for 10 minutes. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder.

The method of synthesis used for RNA including certain siNA molecules of the invention follows the procedure as described in Usman et al., 1987, *J. Am. Chem. Soc.,* 109, 7845; Scaringe et al., 1990, *Nucleic Acids Res.,* 18, 5433; and Wincott et al., 1995, *Nucleic Acids Res.* 23, 2677-2684 Wincott et al., 1997, *Methods Mol. Bio.,* 74, 59, and makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 μmol scale protocol with a 7.5 min coupling step for alkylsilyl protected nucleotides and a 2.5 min coupling step for 2'-O-methylated nucleotides. Table V outlines the amounts and the contact times of the reagents used in the synthesis cycle. Alternatively, syntheses at the 0.2 μmol scale can be done on a 96-well plate synthesizer, such as the instrument produced by Protogene (Palo Alto, Calif.) with minimal modification to the cycle. A 33-fold excess (60 μL of 0.11 M=6.6 μmol) of 2'-O-methyl phosphoramidite and a 75-fold excess of S-ethyl tetrazole (60 μL of 0.25 M=15 μmol) can be used in each coupling cycle of 2'-O-methyl residues relative to polymer-bound 5'-hydroxyl. A 66-fold excess (120 μL of 0.11 M=13.2 μmol) of alkylsilyl (ribo) protected phosphoramidite and a 150-fold excess of S-ethyl tetrazole (120 μL of 0.25 M=30 μmol) can be used in each coupling cycle of ribo residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/ 10% 2,6-lutidine in THF (ABI); oxidation solution is 16.9 mM $I_2$, 49 mM pyridine, 9% water in THF (PERSEPTIVE™). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-benzodithiol-3-one 1,1-dioxide 0.05 M in acetonitrile) is used.

Deprotection of the RNA is performed using either a two-pot or one-pot protocol. For the two-pot protocol, the polymer-bound trityl-on oligoribonucleotide is transferred to a 4 mL glass screw top vial and suspended in a solution of 40% aq. methylamine (1 mL) at 65° C. for 10 minutes. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder. The base deprotected oligoribonucleotide is resuspended in anhydrous TEA/HF/NMP solution (300 μL of a solution of 1.5 mL N-methylpyrrolidinone, 750 μL TEA and 1 mL TEA•3HF to provide a 1.4 M HF concentration) and heated to 65° C. After 1.5 h, the oligomer is quenched with 1.5 M NH$_4$HCO$_3$.

Alternatively, for the one-pot protocol, the polymer-bound trityl-on oligoribonucleotide is transferred to a 4 mL glass screw top vial and suspended in a solution of 33% ethanolic methylamine/DMSO:1/1 (0.8 mL) at 65° C. for 15 minutes. The vial is brought to room temperature TEA•3HF (0.1 mL) is added and the vial is heated at 65° C. for 15 minutes. The sample is cooled at −20° C. and then quenched with 1.5 M NH$_4$HCO$_3$.

For purification of the trityl-on oligomers, the quenched NH$_4$HCO$_3$ solution is loaded onto a C-18 containing cartridge that had been prewashed with acetonitrile followed by 50 mM TEAA. After washing the loaded cartridge with water, the RNA is detritylated with 0.5% TFA for 13 minutes. The cartridge is then washed again with water, salt exchanged with 1 M NaCl and washed with water again. The oligonucleotide is then eluted with 30% acetonitrile.

The average stepwise coupling yields are typically >98% (Wincott et al., 1995 *Nucleic Acids Res.* 23, 2677-2684). Those of ordinary skill in the art will recognize that the scale of synthesis can be adapted to be larger or smaller than the example described above including but not limited to 96-well format.

Alternatively, the nucleic acid molecules of the present invention can be synthesized separately and joined together post-synthetically, for example, by ligation (Moore et al., 1992, *Science* 256, 9923; Draper et al., International PCT publication No. WO 93/23569; Shabarova et al., 1991, *Nucleic Acids Research* 19, 4247; Bellon et al., 1997, *Nucleosides & Nucleotides,* 16, 951; Bellon et al., 1997, *Bioconjugate Chem.* 8, 204), or by hybridization following synthesis and/or deprotection.

The siNA molecules of the invention can also be synthesized via a tandem synthesis methodology as described in Example 1 herein, wherein both siNA strands are synthesized as a single contiguous oligonucleotide fragment or strand separated by a cleavable linker which is subsequently cleaved to provide separate siNA fragments or strands that hybridize and permit purification of the siNA duplex. The linker can be a polynucleotide linker or a non-nucleotide linker. The tandem synthesis of siNA as described herein can be readily adapted to both multiwell/multiplate synthesis platforms such as 96 well or similarly larger multi-well platforms. The tandem synthesis of siNA as described herein can also be readily adapted to large-scale synthesis platforms employing batch reactors, synthesis columns and the like.

An siNA molecule can also be assembled from two distinct nucleic acid strands or fragments wherein one fragment includes the sense region and the second fragment includes the antisense region of the RNA molecule.

The nucleic acid molecules of the present invention can be modified extensively to enhance stability by modification with nuclease resistant groups, for example, 2'-amino, 2'-C-allyl, 2'-fluoro, 2'-O-methyl, 2'-H (for a review see Usman and Cedergren, 1992, *TIBS* 17, 34; Usman et al., 1994, *Nucleic Acids Symp. Ser.* 31, 163). siNA constructs can be purified by gel electrophoresis using general methods or can be purified by high pressure liquid chromatography (HPLC; see Wincott et al., supra, the totality of which is hereby incorporated herein by reference) and re-suspended in water.

In another aspect of the invention, siNA molecules of the invention are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules.

Optimizing Activity of the Nucleic Acid Molecule of the Invention

Chemically synthesizing nucleic acid molecules with modifications (base, sugar and/or phosphate) can prevent their degradation by serum ribonucleases, which can increase their potency (see e.g., Eckstein et al., International Publication No. WO 92/07065; Perrault et al., 1990 *Nature* 344, 565; Pieken et al., 1991, *Science* 253, 314; Usman and Cedergren, 1992, *Trends in Biochem. Sci.* 17, 334; Usman et al., International Publication No. WO 93/15187; and Rossi et al., International Publication No. WO 91/03162; Sproat, U.S. Pat. No. 5,334,711; Gold et al., U.S. Pat. No. 6,300,074; and Burgin et al., supra; all of which are incorporated by reference herein). All of the above references describe various chemical modifications that can be made to the base, phosphate and/or sugar moieties of the nucleic acid molecules described herein. Modifications that enhance their efficacy in cells, and removal of bases from nucleic acid molecules to shorten oligonucleotide synthesis times and reduce chemical requirements are desired.

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-fluoro, 2'-O-methyl, 2'-O-allyl, 2'-H, nucleotide base modifications (for a review see Usman and Cedergren, 1992, *TIBS.* 17, 34; Usman et al., 1994, *Nucleic Acids Symp. Ser.* 31, 163; Burgin et al., 1996, *Biochemistry,* 35, 14090). Sugar modification of nucleic acid molecules have been extensively described in the art (see Eckstein et al., International Publication PCT No. WO 92/07065; Perrault et al. *Nature,* 1990, 344, 565-568; Pieken et al. *Science,* 1991, 253, 314-317; Usman and Cedergren, *Trends in Biochem. Sci.,* 1992, 17, 334-339; Usman et al. International Publication PCT No. WO 93/15187; Sproat, U.S. Pat. No. 5,334,711 and Beigelman et al., 1995, *J. Biol. Chem.,* 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. Ser. No. 60/082,404 which was filed on Apr. 20, 1998; Karpeisky et al., 1998, *Tetrahedron Lett.,* 39, 1131; Earnshaw and Gait, 1998, *Biopolymers (Nucleic Acid Sciences),* 48, 39-55; Verma and Eckstein, 1998, *Annu. Rev. Biochem.,* 67, 99-134; and Burlina et al., 1997, *Bioorg. Med. Chem.,* 5, 1999-2010; all of the references are hereby incorporated in their totality by reference herein). Such publications describe general methods and strategies to determine the location of incorporation of sugar, base and/or phosphate modifications and the like into nucleic acid molecules without modulating catalysis, and are incorporated by reference herein. In view of such teachings, similar modifications can be used as described herein to modify the siNA nucleic acid molecules of the instant invention so long as the ability of siNA to promote RNAi is cells is not significantly inhibited.

While chemical modification of oligonucleotide internucleotide linkages with phosphorothioate, phosphorodithioate, and/or 5'-methylphosphonate linkages improves stability, excessive modifications can cause some toxicity or decreased activity. Therefore, when designing nucleic acid molecules, the amount of these internucleotide linkages should be minimized. The reduction in the concentration of these linkages should lower toxicity, resulting in increased efficacy and higher specificity of these molecules.

Short interfering nucleic acid (siNA) molecules having chemical modifications that maintain or enhance activity are provided. Such a nucleic acid is also generally more resistant to nucleases than an unmodified nucleic acid. Accordingly, the in vitro and/or in vivo activity should not be significantly lowered. In cases in which modulation is the goal, therapeutic nucleic acid molecules delivered exogenously should optimally be stable within cells until translation of the target RNA has been modulated long enough to reduce the levels of the undesirable protein. This period of time varies between hours to days depending upon the disease state. Improvements in the chemical synthesis of RNA and DNA (Wincott et al., 1995, *Nucleic Acids Res.* 23, 2677; Caruthers et al., 1992, *Methods in Enzymology* 211, 3-19 (incorporated by reference herein)) have expanded the ability to modify nucleic acid molecules by introducing nucleotide modifications to enhance their nuclease stability, as described above.

In one embodiment, nucleic acid molecules of the invention include one or more (e.g., about 1, 2, 3, 4, 5, 6, 7, 8, 9, 10, or more) G-clamp nucleotides. A G-clamp nucleotide is a modified cytosine analog wherein the modifications confer the ability to hydrogen bond both Watson-Crick and Hoogsteen faces of a complementary guanine within a duplex, see for example Lin and Matteucci, 1998, *J. Am. Chem. Soc.*, 120, 8531-8532. A single G-clamp analog substitution within an oligonucleotide can result in substantially enhanced helical thermal stability and mismatch discrimination when hybridized to complementary oligonucleotides. The inclusion of such nucleotides in nucleic acid molecules of the invention results in both enhanced affinity and specificity to nucleic acid targets, complementary sequences, or template strands. In another embodiment, nucleic acid molecules of the invention include one or more (e.g., about 1, 2, 3, 4, 5, 6, 7, 8, 9, 10, or more) LNA "locked nucleic acid" nucleotides such as a 2',4'-C methylene bicyclo nucleotide (see for example Wengel et al., International PCT Publication No. WO 00/66604 and WO 99/14226).

In another embodiment, the invention features conjugates and/or complexes of siNA molecules of the invention. Such conjugates and/or complexes can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. The present invention encompasses the design and synthesis of novel conjugates and complexes for the delivery of molecules, including, but not limited to, small molecules, lipids, phospholipids, cholesterol, nucleosides, nucleotides, nucleic acids, antibodies, toxins, negatively charged polymers and other polymers, for example proteins, peptides, hormones, carbohydrates, polyethylene glycols, or polyamines, across cellular membranes. In general, the transporters described are designed to be used either individually or as part of a multi-component system, with or without degradable linkers. These compounds are expected to improve delivery and/or localization of nucleic acid molecules of the invention into a number of cell types originating from different tissues, in the presence or absence of serum (see Sullenger and Cech, U.S. Pat. No. 5,854,038). Conjugates of the molecules described herein can be attached to biologically active molecules via linkers that are biodegradable, such as biodegradable nucleic acid linker molecules.

The term "biodegradable linker" as used herein, refers to a nucleic acid or non-nucleic acid linker molecule that is designed as a biodegradable linker to connect one molecule to another molecule, for example, a biologically active molecule to an siNA molecule of the invention or the sense and antisense strands of an siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The term "biodegradable" as used herein, refers to degradation in a biological system, for example enzymatic degradation or chemical degradation.

The term "biologically active molecule" as used herein, refers to compounds or molecules that are capable of eliciting or modifying a biological response in a system. Non-limiting examples of biologically active siNA molecules either alone or in combination with other molecules contemplated by the instant invention include therapeutically active molecules such as antibodies, cholesterol, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, 2,5-A chimeras, siNA, dsRNA, allozymes, aptamers, decoys and analogs thereof. Biologically active molecules of the invention also include molecules capable of modulating the pharmacokinetics and/or pharmacodynamics of other biologically active molecules, for example, lipids and polymers such as polyamines, polyamides, polyethylene glycol and other polyethers.

The term "phospholipid" as used herein, refers to a hydrophobic molecule comprising at least one phosphorus group. For example, a phospholipid can comprise a phosphorus-containing group and saturated or unsaturated alkyl group, optionally substituted with OH, COOH, oxo, amine, or substituted or unsubstituted aryl groups.

Therapeutic nucleic acid molecules (e.g., siNA molecules) delivered exogenously optimally are stable within cells until reverse transcription of the RNA has been modulated long enough to reduce the levels of the RNA transcript. The nucleic acid molecules are resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

In yet another embodiment, siNA molecules having chemical modifications that maintain or enhance enzymatic activity of proteins involved in RNAi are provided. Such nucleic acids are also generally more resistant to nucleases than unmodified nucleic acids. Thus, in vitro and/or in vivo the activity should not be significantly lowered.

Use of the nucleic acid-based molecules of the invention will lead to better treatment of the disease progression by affording the possibility of combination therapies (e.g., multiple siNA molecules targeted to different genes; nucleic acid molecules coupled with known small molecule modulators; or intermittent treatment with combinations of molecules, including different motifs and/or other chemical or biological molecules). The treatment of subjects with siNA molecules can also include combinations of different types of nucleic acid molecules, such as enzymatic nucleic acid molecules (ribozymes), allozymes, antisense, 2,5-A oligoadenylate, decoys, and aptamers.

In another aspect an siNA molecule of the invention comprises one or more 5' and/or 3'-cap structure(s), for example on only the sense siNA strand, the antisense siNA strand, or both siNA strands.

By "cap structure" is meant chemical modifications, which have been incorporated at either terminus of the oligonucleotide (see, for example, Adamic et al., U.S. Pat. No. 5,998, 203, incorporated by reference herein). These terminal modifications protect the nucleic acid molecule from exonuclease degradation, and may help in delivery and/or localization within a cell. The cap may be present at the 5'-terminus (5'-cap) or at the 3'-terminal (3'-cap) or may be present on both termini. In non-limiting examples, the 5'-cap includes, but is not limited to glyceryl, inverted deoxy abasic residue (moiety); 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety.

In non-limiting examples, the 3'-cap includes, but is not limited to glyceryl, inverted deoxy abasic residue (moiety), 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non-bridging methylphosphonate and 5'-mercapto moieties (for more details see Beaucage and Iyer, 1993, *Tetrahedron* 49, 1925; incorporated by reference herein).

By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine and therefore lacks a base at the 1'-position.

An "alkyl" group refers to a saturated aliphatic hydrocarbon, including straight-chain, branched-chain, and cyclic alkyl groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted the substituted group(s) is preferably, hydroxyl, cyano, alkoxy, =O, =S, $NO_2$ or $N(CH_3)_2$, amino, or SH. The term also includes alkenyl groups that are unsaturated hydrocarbon groups containing at least one carbon-carbon double bond, including straight-chain, branched-chain, and cyclic groups. Preferably, the alkenyl group has 1 to 12 carbons. More preferably, it is a lower alkenyl of from 1 to 7 carbons, more preferably 1 to 4 carbons. The alkenyl group may be substituted or unsubstituted. When substituted the substituted group(s) is preferably, hydroxyl, cyano, alkoxy, =O, =S, $NO_2$, halogen, $N(CH_3)_2$, amino, or SH. The term "alkyl" also includes alkynyl groups that have an unsaturated hydrocarbon group containing at least one carbon-carbon triple bond, including straight-chain, branched-chain, and cyclic groups. Preferably, the alkynyl group has 1 to 12 carbons. More preferably, it is a lower alkynyl of from 1 to 7 carbons, more preferably 1 to 4 carbons. The alkynyl group may be substituted or unsubstituted. When substituted the substituted group(s) is preferably, hydroxyl, cyano, alkoxy, =O, =S, $NO_2$ or $N(CH_3)_2$, amino or SH.

Such alkyl groups can also include aryl, alkylaryl, carbocyclic aryl, heterocyclic aryl, amide and ester groups. An "aryl" group refers to an aromatic group that has at least one ring having a conjugated pi electron system and includes carbocyclic aryl, heterocyclic aryl and biaryl groups, all of which may be optionally substituted. The preferred substituent(s) of aryl groups are halogen, trihalomethyl, hydroxyl, SH, OH, cyano, alkoxy, alkyl, alkenyl, alkynyl, and amino groups. An "alkylaryl" group refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and include furanyl, thienyl, pyridyl, pyrrolyl, N-lower alkyl pyrrolo, pyrimidyl, pyrazinyl, imidazolyl and the like, all optionally substituted. An "amide" refers to an —C(O)—NH—R, where R is either alkyl, aryl, alkylaryl or hydrogen. An "ester" refers to an —C(O)—OR', where R is either alkyl, aryl, alkylaryl or hydrogen.

"Nucleotide" as used herein and as recognized in the art includes natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, for example, Usman and McSwiggen, supra; Eckstein et al., International PCT Publication No. WO 92/07065; Usman et al., International PCT Publication No. WO 93/15187; Uhlman & Peyman, supra, all are hereby incorporated by reference herein).

There are several examples of modified nucleic acid bases known in the art as summarized by Limbach et al., 1994, *Nucleic Acids Res.* 22, 2183. Some of the non-limiting examples of base modifications that can be introduced into nucleic acid molecules include, inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin et al., 1996, *Biochemistry*, 35, 14090; Uhlman & Peyman, supra). By "modified bases" in this aspect is meant nucleotide bases other than adenine, guanine, cytosine and uracil at 1' position or their equivalents.

In one embodiment, the invention features modified siNA molecules, with phosphate backbone modifications comprising one or more phosphorothioate, phosphorodithioate, methylphosphonate, phosphotriester, morpholino, amidate carbamate, carboxymethyl, acetamidate, polyamide, sulfonate, sulfonamide, sulfamate, formacetal, thioformacetal, and/or alkylsilyl, substitutions. For a review of oligonucleotide backbone modifications, see Hunziker and Leumann, 1995, *Nucleic Acid Analogues: Synthesis and Properties*, in *Modern Synthetic Methods*, VCH, 331-417, and Mesmaeker et al., 1994, *Novel Backbone Replacements for Oligonucleotides*, in *Carbohydrate Modifications in Antisense Research*, ACS, 24-39.

By "abasic" is meant sugar moieties lacking a base or having other chemical groups in place of a base at the 1' position, see for example Adamic et al., U.S. Pat. No. 5,998,203.

By "unmodified nucleoside" is meant one of the bases adenine, cytosine, guanine, thymine, or uracil joined to the 1' carbon of β-D-ribo-furanose.

By "modified nucleoside" is meant any nucleotide base which contains a modification in the chemical structure of an unmodified nucleotide base, sugar and/or phosphate. Non-limiting examples of modified nucleotides are shown by Formulae I-VII and/or other modifications described herein.

In connection with 2'-modified nucleotides as described for the present invention, by "amino" is meant 2'—$NH_2$ or 2'-O—$NH_2$, which can be modified or unmodified. Such modified groups are described, for example, in Eckstein et al., U.S. Pat. No. 5,672,695 and Matulic-Adamic et al., U.S. Pat. No. 6,248,878, which are both incorporated by reference in their entireties.

Various modifications to nucleic acid siNA structure can be made to enhance the utility of these molecules. Such modifications will enhance shelf-life, half-life in vitro, stability, and ease of introduction of such oligonucleotides to the target site, e.g., to enhance penetration of cellular membranes, and confer the ability to recognize and bind to targeted cells.

Administration of Nucleic Acid Molecules

An siRNA molecule of the invention can be adapted for use to treat for example HCV infection, liver failure, hepatocellular carcinoma, cirrhosis and other indications that can respond to the level of HCV in a cell or tissue, alone or in combination with other therapies. For example, an siNA molecule can comprise a delivery vehicle, including liposomes, for administration to a subject, carriers and diluents and their salts, and/or can be present in pharmaceutically acceptable formulations. Methods for the delivery of nucleic acid molecules are described in Akhtar et al., 1992, *Trends Cell Bio.*, 2, 139; *Delivery Strategies for Antisense Oligonucleotide Therapeutics*, ed. Akhtar, 1995, Maurer et al., 1999, *Mol. Membr. Biol.*, 16, 129-140; Hofland and Huang, 1999, *Handb. Exp. Pharmacol.*, 137, 165-192; and Lee et al., 2000, *ACS Symp. Ser.*, 752, 184-192, all of which are incorporated herein by reference. Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see for example Gonzalez et al., 1999, *Bioconjugate Chem.*, 10, 1068-1074; Wang et al., International PCT publication Nos. WO 03/47518 and WO 03/46185), poly(lactic-co-glycolic)acid (PLGA) and PLCA microspheres (see for example U.S. Pat. No. 6,447,796 and U.S. Patent Application Publication No. U.S. 2002130430), biodegradable nanocapsules, and bioadhesive microspheres, or by proteinaceous vectors (O'Hare and Normand, International PCT Publication No. WO 00/53722). Alternatively, the nucleic acid/vehicle combination is locally delivered by direct injection or by use of an infusion pump. Direct injection of the nucleic acid molecules of the invention, whether subcutaneous, intramuscular, or intradermal, can take place using standard needle and syringe methodologies, or by needle-free technologies such as those described in Conry et al., 1999, *Clin. Cancer Res.*, 5, 2330-2337 and Barry et al., International PCT Publication No. WO 99/31262. The molecules of the instant invention can be used as pharmaceutical agents. Pharmaceutical agents prevent, modulate the occurrence, or treat (alleviate a symptom to some extent, preferably all of the symptoms) of a disease state in a subject.

In one embodiment, an siNA molecule of the invention is complexed with membrane disruptive agents such as those described in U.S. Patent Application Publication No. 20010007666, incorporated by reference herein in its entirety including the drawings. In another embodiment, the membrane disruptive agent or agents and the siNA molecule are also complexed with a cationic lipid or helper lipid molecule, such as those lipids described in U.S. Pat. No. 6,235,310, incorporated by reference herein in its entirety including the drawings.

Thus, the invention features a pharmaceutical composition comprising one or more nucleic acid(s) of the invention in an acceptable carrier, such as a stabilizer, buffer, and the like. The polynucleotides of the invention can be administered (e.g., RNA, DNA or protein) and introduced into a subject by any standard means, with or without stabilizers, buffers, and the like, to form a pharmaceutical composition. When it is desired to use a liposome delivery mechanism, standard protocols for formation of liposomes can be followed. The compositions of the present invention can also be formulated and used as tablets, capsules or elixirs for oral administration, suppositories for rectal administration, sterile solutions, suspensions for injectable administration, and the other compositions known in the art.

The present invention also includes pharmaceutically acceptable formulations of the compounds described. These formulations include salts of the above compounds, e.g., acid addition salts, for example, salts of hydrochloric, hydrobromic, acetic acid, and benzene sulfonic acid.

A pharmacological composition or formulation refers to a composition or formulation in a form suitable for administration, e.g., systemic administration, into a cell or subject, including for example a human. Suitable forms, in part, depend upon the use or the route of entry, for example oral, transdermal, or by injection. Such forms should not prevent the composition or formulation from reaching a target cell (i.e., a cell to which the negatively charged nucleic acid is desirable for delivery). For example, pharmacological compositions injected into the blood stream should be soluble. Other factors are known in the art, and include considerations such as toxicity and forms that prevent the composition or formulation from exerting its effect.

By "systemic administration" is meant in vivo systemic absorption or accumulation of drugs in the blood stream followed by distribution throughout the entire body. Administration routes that lead to systemic absorption include, without limitation: intravenous, subcutaneous, intraperitoneal, inhalation, oral, intrapulmonary and intramuscular. Each of these administration routes exposes the siNA molecules of the invention to an accessible diseased tissue. The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation that can facilitate the association of drug with the surface of cells, such as, lymphocytes and macrophages is also useful. This approach can provide enhanced delivery of the drug to target cells by taking advantage of the specificity of macrophage and lymphocyte immune recognition of abnormal cells, such as cells producing excess HCV.

By "pharmaceutically acceptable formulation" is meant, a composition or formulation that allows for the effective distribution of the nucleic acid molecules of the instant invention in the physical location most suitable for their desired activity. Non-limiting examples of agents suitable for formulation with the nucleic acid molecules of the instant invention include: P-glycoprotein inhibitors (such as Pluronic P85), which can enhance entry of drugs into the CNS (Jolliet-Riant and Tillement, 1999, *Fundam. Clin. Pharmacol.,* 13, 16-26); biodegradable polymers, such as poly (DL-lactide-coglycolide) microspheres for sustained release delivery after intracerebral implantation (Emerich, D F et al, 1999, *Cell Transplant,* 8, 47-58) (Alkermes, Inc. Cambridge, Mass.); and loaded nanoparticles, such as those made of polybutylcyanoacrylate, which can deliver drugs across the blood brain barrier and can alter neuronal uptake mechanisms (*Prog Neuropsychopharmacol Biol Psychiatry,* 23, 941-949, 1999). Other non-limiting examples of delivery strategies for the nucleic acid molecules of the instant invention include material described in Boado et al., 1998, *J. Pharm. Sci.,* 87, 1308-1315; Tyler et al., 1999, *FEBS Lett.,* 421, 280-284; Pardridge et al., 1995, *PNAS USA.,* 92, 5592-5596; Boado, 1995, *Adv. Drug Delivery Rev.,* 15, 73-107; Aldrian-Herrada et al., 1998, *Nucleic Acids Res.,* 26, 4910-4916; and Tyler et al., 1999, *PNAS USA.,* 96, 7053-7058.

The invention also features the use of the composition comprising surface-modified liposomes containing poly (ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev.* 1995, 95, 2601-2627; Ishiwata et al., *Chem. Pharm. Bull.* 1995, 43, 1005-1011). Such liposomes have been shown to accumulate selectively in tumors, presumably by extravasation and capture in the neovascularized target tissues (Lasic et al., *Science* 1995, 267, 1275-1276; Oku et al., 1995, *Biochim. Biophys. Acta,* 1238, 86-90). The long-circulating liposomes enhance the pharmacokinetics and pharmacodynamics of DNA and RNA, particularly compared to conventional cationic liposomes which are known to accumulate in tissues of the MPS (Liu et al., *J. Biol. Chem.* 1995, 42, 24864-24870; Choi et al., International PCT Publication No. WO 96/10391; Ansell et al., International PCT Publication No. WO 96/10390; Holland et al., International PCT Publication No. WO 96/10392). Long-circulating liposomes are also likely to protect drugs from nuclease degradation to a greater extent compared to cationic liposomes, based on their ability to avoid accumulation in metabolically aggressive MPS tissues such as the liver and spleen.

The present invention also includes compositions prepared for storage or administration that include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences,* Mack Publishing Co. (A. R. Gennaro edit. 1985), hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors that those skilled in the medical arts will recognize. Generally, an amount between 0.1 mg/kg and 100 mg/kg body weight/day of active ingredients is administered dependent upon potency of the negatively charged polymer.

The nucleic acid molecules of the invention and formulations thereof can be administered orally, topically, parenterally, by inhalation or spray, or rectally in dosage unit formulations containing conventional non-toxic pharmaceutically acceptable carriers, adjuvants and/or vehicles. The term parenteral as used herein includes percutaneous, subcutaneous, intravascular (e.g., intravenous), intramuscular, or intrathecal injection or infusion techniques and the like. In addition, there is provided a pharmaceutical formulation comprising a nucleic acid molecule of the invention and a pharmaceutically acceptable carrier. One or more nucleic acid molecules of the invention can be present in association with one or more non-toxic pharmaceutically acceptable carriers and/or diluents and/or adjuvants, and if desired other active ingredients. The pharmaceutical compositions containing nucleic acid molecules of the invention can be in a form suitable for oral use, for example, as tablets, troches, lozenges, aqueous or oily suspensions, dispersible powders or granules, emulsion, hard or soft capsules, or syrups or elixirs.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate;

granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monostearate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate, or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid Dispersible powders and granules suitable for preparation of an aqueous suspension by the addition of water provide the active ingredient in admixture with a dispersing or wetting agent, suspending agent and one or more preservatives. Suitable dispersing or wetting agents or suspending agents are exemplified by those already mentioned above. Additional excipients, for example sweetening, flavoring and coloring agents, can also be present.

Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono- or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

Dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular subject depends upon a variety of factors including the activity of the specific compound employed, the age, body weight, general health, sex, diet, time of administration, route of administration, and rate of excretion, drug combination and the severity of the particular disease undergoing therapy.

For administration to non-human animals, the composition can also be added to the animal feed or drinking water. It can be convenient to formulate the animal feed and drinking water compositions so that the animal takes in a therapeutically appropriate quantity of the composition along with its diet. It can also be convenient to present the composition as a premix for addition to the feed or drinking water.

The nucleic acid molecules of the present invention can also be administered to a subject in combination with other therapeutic compounds to increase the overall therapeutic effect. The use of multiple compounds to treat an indication can increase the beneficial effects while reducing the presence of side effects.

In one embodiment, the invention comprises compositions suitable for administering nucleic acid molecules of the invention to specific cell types. For example, the asialoglycoprotein receptor (ASGPr) (Wu and Wu, 1987, *J. Biol. Chem.* 262, 4429-4432) is unique to hepatocytes and binds branched galactose-terminal glycoproteins, such as asialoorosomucoid (ASOR). In another example, the folate receptor is overexpressed in many cancer cells. Binding of such glycoproteins, synthetic glycoconjugates, or folates to the receptor takes place with an affinity that strongly depends on the degree of branching of the oligosaccharide chain, for example, triatennary structures are bound with greater affinity than biatennary or monoatennary chains (Baenziger and Fiete, 1980, *Cell*, 22, 611-620; Connolly et al., 1982, *J. Biol. Chem.*, 257, 939-945). Lee and Lee, 1987, *Glycoconjugate J.*, 4, 317-328, obtained this high specificity through the use of N-acetyl-D-galactosamine as the carbohydrate moiety, which has higher affinity for the receptor, compared to galactose. This "clustering effect" has also been described for the binding and uptake of mannosyl-terminating glycoproteins or glycoconjugates (Ponpipom et al., 1981, *J. Med. Chem.*, 24, 1388-1395). The use of galactose, galactosamine, or folate based conjugates to transport exogenous compounds across cell membranes can provide a targeted delivery approach to, for example, the treatment of liver disease, cancers of the liver, or other cancers. The use of bioconjugates can also provide a reduction in the required dose of therapeutic compounds required for treatment. Furthermore, therapeutic bioavailability, pharmacodynamics, and pharmacokinetic parameters can be modulated through the use of nucleic acid bioconjugates of the invention. Non-limiting examples of such bioconjugates are described in Vargeese et al., U.S. Ser. No. 10/201,394, filed Aug. 13, 2001; and Matulic-Adamic et al., U.S. Ser. No. 10/151,116, filed May 17, 2002. In one embodiment, nucleic acid molecules of the invention are complexed with or covalently attached to nanoparticles, such as Hepatitis B virus S, M, or L envelope proteins (see for example Yamado et al., 2003, *Nature Biotechnology*, 21, 885).

Alternatively, certain siNA molecules of the instant invention can be expressed within cells from eukaryotic promoters (e.g., Izant and Weintraub, 1985, *Science*, 229, 345; McGarry and Lindquist, 1986, *Proc. Natl. Acad. Sci.*, USA 83, 399; Scanlon et al., 1991, *Proc. Natl. Acad. Sci. USA*, 88, 10591-5; Kashani-Sabet et al., 1992, *Antisense Res. Dev.*, 2, 3-15; Dropulic et al., 1992, *J. Virol.*, 66, 1432-41; Weerasinghe et al., 1991, *J. Virol.*, 65, 5531-4; Ojwang et al., 1992, *Proc. Natl. Acad. Sci. USA*, 89, 10802-6; Chen et al., 1992, *Nucleic Acids Res.*, 20, 4581-9; Sarver et al., 1990 *Science*, 247, 1222-1225; Thompson et al., 1995, *Nucleic Acids Res.*, 23, 2259; Good et al., 1997, *Gene Therapy*, 4, 45. Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, *Nucleic Acids Symp. Ser.*, 27, 15-6; Taira et al., 1991, *Nucleic Acids Res.*, 19, 5125-30; Ventura et al., 1993, *Nucleic Acids Res.*, 21, 3249-55; Chowrira et al., 1994, *J. Biol. Chem.*, 269, 25856.

In another aspect of the invention, RNA molecules of the present invention can be expressed from transcription units (see for example Couture et al., 1996, *TIG.*, 12, 510) inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. In another embodiment, pol III based constructs are used to express nucleic acid molecules of the invention (see for example Thompson, U.S. Pats. Nos. 5,902,880 and 6,146,886). The recombinant vectors capable of expressing the siNA molecules can be delivered as described above, and persist in target cells. Alternatively, viral vectors can be used that provide for transient expression of nucleic acid molecules. Such vectors can be repeatedly administered as necessary. Once expressed, the siNA molecule interacts with the target mRNA and generates an RNAi response. Delivery of siNA molecule expressing vectors can be systemic, such as by intravenous or intramuscular administration, by administration to target cells ex-planted from a subject followed by reintroduction into the subject, or by any other means that would allow for introduction into the desired target cell (for a review see Couture et al., 1996, *TIG.*, 12, 510).

In one aspect the invention features an expression vector comprising a nucleic acid sequence encoding at least one siNA molecule of the instant invention. The expression vector can encode one or both strands of an siNA duplex, or a single self-complementary strand that self hybridizes into an siNA duplex. The nucleic acid sequences encoding the siNA molecules of the instant invention can be operably linked in a manner that allows expression of the siNA molecule (see for example Paul et al., 2002, *Nature Biotechnology*, 19, 505; Miyagishi and Taira, 2002, *Nature Biotechnology*, 19, 497; Lee et al., 2002, *Nature Biotechnology*, 19, 500; and Novina et al., 2002, *Nature Medicine*, advance online publication doi: 10.1038/nm725).

In another aspect, the invention features an expression vector comprising: a) a transcription initiation region (e.g., eukaryotic pol I, II or III initiation region); b) a transcription termination region (e.g., eukaryotic pol I, II or III termination region); and c) a nucleic acid sequence encoding at least one of the siNA molecules of the instant invention; wherein said sequence is operably linked to said initiation region and said termination region, in a manner that allows expression and/or delivery of the siNA molecule. The vector can optionally include an open reading frame (ORF) for a protein operably linked on the 5' side or the 3'-side of the sequence encoding the siNA of the invention; and/or an intron (intervening sequences).

Transcription of the siNA molecule sequences can be driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, *Proc. Natl. Acad. Sci. USA*, 87, 6743-7; Gao and Huang 1993, *Nucleic Acids Res.*, 21, 2867-72; Lieber et al., 1993, *Methods Enzymol.*, 217, 47-66; Zhou et al., 1990, *Mol. Cell. Biol.*, 10, 4529-37). Several investigators have demonstrated that nucleic acid molecules expressed from such promoters can function in mammalian cells (e.g. Kashani-Sabet et al., 1992, *Antisense Res. Dev.*, 2, 3-15; Ojwang et al., 1992, *Proc. Natl. Acad. Sci. USA*, 89, 10802-6; Chen et al., 1992, *Nucleic Acids Res.*, 20, 4581-9; Yu et al., 1993, *Proc. Natl. Acad. Sci. USA*, 90, 6340-4; L'Huillier et al., 1992, *EMBO J.*, 11, 4411-8; Lisziewicz et al., 1993, *Proc. Natl. Acad. Sci. U.S.A.*, 90, 8000-4; Thompson et al., 1995, *Nucleic Acids Res.*, 23, 2259; Sullenger & Cech, 1993, *Science*, 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, *Nucleic Acid Res.*, 22, 2830; Noonberg et al., U.S. Pat. No. 5,624,803; Good et al., 1997, *Gene Ther.*, 4, 45; Beigelman et al., International PCT Publication No. WO 96/18736. The above siNA transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

In another aspect the invention features an expression vector comprising a nucleic acid sequence encoding at least one of the siNA molecules of the invention in a manner that allows expression of that siNA molecule. The expression vector comprises in one embodiment; a) a transcription initiation region; b) a transcription termination region; and c) a nucleic acid sequence encoding at least one strand of the siNA molecule, wherein the sequence is operably linked to the initiation region and the termination region in a manner that allows expression and/or delivery of the siNA molecule.

In another embodiment the expression vector comprises: a) a transcription initiation region; b) a transcription termination region; c) an open reading frame; and d) a nucleic acid sequence encoding at least one strand of an siNA molecule, wherein the sequence is operably linked to the 3'-end of the open reading frame and wherein the sequence is operably linked to the initiation region, the open reading frame and the termination region in a manner that allows expression and/or delivery of the siNA molecule.

In yet another embodiment, the expression vector comprises: a) a transcription initiation region; b) a transcription termination region; c) an intron; and d) a nucleic acid sequence encoding at least one siNA molecule, wherein the sequence is operably linked to the initiation region, the intron and the termination region in a manner which allows expression and/or delivery of the nucleic acid molecule.

In another embodiment, the expression vector comprises: a) a transcription initiation region; b) a transcription termination region; c) an intron; d) an open reading frame; and e) a nucleic acid sequence encoding at least one strand of an siNA molecule, wherein the sequence is operably linked to the 3'-end of the open reading frame and wherein the sequence is operably linked to the initiation region, the intron, the open reading frame and the termination region in a manner which allows expression and/or delivery of the siNA molecule.

HCV Biology and Biochemistry

In 1989, the Hepatitis C Virus (HCV) was determined to be an RNA virus and was identified as the causative agent of most non-A non-B viral Hepatitis (Choo et al., 1989, *Science,* 244, 359-362). Unlike retroviruses such as HIV, HCV does not go though a DNA replication phase and no integrated forms of the viral genome into the host chromosome have been detected (Houghton et al., 1991, *Hepatology,* 14, 381-388). Rather, replication of the coding (plus) strand is mediated by the production of a replicative (minus) strand leading to the generation of several copies of plus strand HCV RNA. The genome consists of a single, large, open-reading frame that is translated into a polyprotein (Kato et al., 1991, *FEBS Letters,* 280: 325-328). This polyprotein subsequently undergoes post-translational cleavage, producing several viral proteins (Leinbach et al., 1994, *Virology,* 204:163-169).

Examination of the 9.5-kilobase genome of HCV has demonstrated that the viral nucleic acid can mutate at a high rate (Smith et al., 1997 *Mol. Evol.* 45, 238-246). This rate of mutation has led to the evolution of several distinct genotypes of HCV that share approximately 70% sequence identity (Simmonds et al., 1994, *J. Gen. Virol.* 75, 1053-1061). It is important to note that these sequences are evolutionarily quite distant. For example, the genetic identity between humans and primates such as the chimpanzee is approximately 98%. In addition, it has been demonstrated that an HCV infection in an individual patient is composed of several distinct and evolving quasispecies that have 98% identity at the RNA level. Thus, the HCV genome is hypervariable and continuously changing. Although the HCV genome is hypervariable, there are 3 regions of the genome that are highly conserved. These conserved sequences occur in the 5' and 3' non-coding regions as well as the 5'-end of the core protein coding region and are thought to be vital for HCV RNA replication as well as translation of the HCV polyprotein. Thus, therapeutic agents that target these conserved HCV genomic regions may have a significant impact over a wide range of HCV genotypes. Moreover, it is unlikely that drug resistance will occur with enzymatic nucleic acids specific to conserved regions of the HCV genome. In contrast, therapeutic modalities that target inhibition of enzymes such as the viral proteases or helicase are likely to result in the selection for drug resistant strains since the RNA for these viral encoded enzymes is located in the hypervariable portion of the HCV genome.

After initial exposure to HCV, a patient experiences a transient rise in liver enzymes, which indicates that inflammatory processes are occurring (Alter et al., IN: Seeff L B, Lewis J H, eds. *Current Perspectives in Hepatology*. New York: Plenum Medical Book Co; 1989:83-89). This elevation in liver enzymes occurs at least 4 weeks after the initial exposure and may last for up to two months (Farci et al., 1991, *New England Journal of Medicine.* 325, 98-104). Prior to the rise in liver enzymes, it is possible to detect HCV RNA in the patient's serum using RT-PCR analysis (Takahashi et al., 1993, *American Journal of Gastroenterology.* 88, 240-243). This stage of the disease is called the acute stage and usually goes undetected since 75% of patients with acute viral hepatitis from HCV infection are asymptomatic. The remaining 25% of these patients develop jaundice or other symptoms of hepatitis.

Although acute HCV infection is a benign disease, as many as 80% of acute HCV patients progress to chronic liver disease as evidenced by persistent elevation of serum alanine aminotransferase (ALT) levels and by continual presence of circulating HCV RNA (Sherlock, 1992, *Lancet,* 339, 802). The natural progression of chronic HCV infection over a 10 to 20 year period leads to cirrhosis in 20 to 50% of patients (Davis et al., 1993, *Infectious Agents and Disease,* 2, 150, 154) and progression of HCV infection to hepatocellular carcinoma has been well documented (Liang et al., 1993, *Hepatology.* 18, 1326-1333; Tong et al., 1994, *Western Journal of Medicine,* 160, 133-138). There have been no studies that have determined sub-populations that are most likely to progress to cirrhosis and/or hepatocellular carcinoma, thus all patients have equal risk of progression.

It is important to note that the survival for patients diagnosed with hepatocellular carcinoma is only 0.9 to 12.8 months from initial diagnosis (Takahashi et al., 1993, *American Journal of Gastroenterology* 88, 240-243). Treatment of hepatocellular carcinoma with chemotherapeutic agents has not proven effective and only 10% of patients will benefit from surgery due to extensive tumor invasion of the liver (Trinchet et al., 1994, *Presse Medicine.* 23, 831-833). Given the aggressive nature of primary hepatocellular carcinoma, the only viable treatment alternative to surgery is liver transplantation (Pichlmayr et al., 1994, *Hepatology.* 20, 33S-40S).

Upon progression to cirrhosis, patients with chronic HCV infection present clinical features, which are common to clinical cirrhosis regardless of the initial cause (D'Amico et al., 1986, *Digestive Diseases and Sciences.* 31, 468-475). These clinical features may include: bleeding esophageal varices, ascites, jaundice, and encephalopathy (Zakim D, Boyer T D. Hepatology a textbook of liver disease. Second Edition Volume 1. 1990 W.B. Saunders Company. Philadelphia). In the early stages of cirrhosis, patients are classified as compensated, the stage at which the patient's liver is still able to detoxify metabolites in the blood-stream although liver tissue damage has occurred. In addition, most patients with compensated liver disease are asymptomatic and the minority with symptoms report only minor symptoms, such as dyspepsia and weakness. In the later stages of cirrhosis, patients are classified as decompensated, the stage at which the ability of the liver to detoxify metabolites in the bloodstream is diminished. It is at the decompensated stage that the clinical features described above present.

In 1986, D'Amico et al. described the clinical manifestations and survival rates in 1155 patients with both alcoholic and viral associated cirrhosis (D'Amico supra). Of the 1155 patients, 435 (37%) had compensated disease although 70% were asymptomatic at the beginning of the study. The remaining 720 patients (63%) had decompensated liver disease with 78% presenting with a history of ascites, 31% with jaundice, 17% had bleeding and 16% had encephalopathy. Hepatocellular carcinoma was observed in six (0.5%) patients with compensated disease and in 30 (2.6%) patients with decompensated disease.

Over the course of six years, the patients with compensated cirrhosis developed clinical features of decompensated disease at a rate of 10% per year. In most cases, ascites was the first presentation of decompensation. In addition, hepatocellular carcinoma developed in 59 patients who initially presented with compensated disease by the end of the six-year study.

With respect to survival, the D'Amico study indicated that the five-year survival rate for all patients in the study was only 40%. The six-year survival rate for the patients who initially had compensated cirrhosis was 54% while the six-year survival rate for patients who initially presented with decompensated disease was only 21%. There were no significant differences in the survival rates between the patients who had alcoholic cirrhosis and the patients with viral related cirrhosis. The major causes of death for the patients in the D'Amico study were liver failure in 49%; hepatocellular carcinoma in 22%; and bleeding in 13% (D'Amico supra).

Chronic Hepatitis C is a slowly progressing inflammatory disease of the liver, mediated by a virus (HCV) that can lead to cirrhosis, liver failure and/or hepatocellular carcinoma over a period of 10 to 20 years. In the U.S., it is estimated that infection with HCV accounts for 50,000 new cases of acute hepatitis in the United States each year (NIH Consensus Development Conference Statement on Management of Hepatitis C March 1997). The prevalence of HCV in the United States is estimated at 1.8% and the CDC places the number of chronically infected Americans at approximately 4.5 million people. The CDC also estimates that up to 10,000 deaths per year are caused by chronic HCV infection.

Numerous well controlled clinical trials using interferon (IFN-alpha) in the treatment of chronic HCV infection have demonstrated that treatment three times a week results in lowering of serum ALT values in approximately 50% (40%-70%) of patients by the end of 6 months of therapy (Davis et al., 1989, *New England Journal of Medicine*, 321, 1501-1506; Marcellin et al., 1991, *Hepatology*, 13, 393-397; Tong et al., 1997, *Hepatology*, 26, 747-754; Tong et al., 1997, *Hepatology*, 26, 1640-1645). However, following cessation of interferon treatment, approximately 50% of the responding patients relapsed, resulting in a "durable" response rate as assessed by normalization of serum ALT concentrations of approximately 20-25%.

Direct measurement of HCV RNA is possible through use of either the branched-DNA or Reverse Transcriptase Polymerase Chain Reaction (RT-PCR) analysis. In general, RT-PCR methodology is more sensitive and leads to a more accurate assessment of the clinical course (Tong et al., supra). Studies that have examined six months of type 1 interferon therapy using changes in HCV RNA values as a clinical endpoint have demonstrated that up to 35% of patients have a loss of HCV RNA by the end of therapy (Marcellin et al., supra). However, as with the ALT endpoint, about 50% of the patients relapse within six months following cessation of therapy, resulting in a durable virologic response of only 12% (Marcellin et al., supra). Studies that have examined 48 weeks of therapy have demonstrated that the sustained virological response is up to 25% (NIH consensus statement: 1997). Thus, standard of care for treatment of chronic HCV infection with type 1 interferon is now 48 weeks of therapy using changes in HCV RNA concentrations as the primary assessment of efficacy (Hoofnagle et al., 1997, *New England Journal of Medicine*, 336, 347-356).

Side effects resulting from treatment with type 1 interferons can be divided into four general categories, which include: (1) Influenza-like symptoms; (2) Neuropsychiatric; (3) Laboratory abnormalities; and (4) Miscellaneous (Dusheiko et al., 1994, Journal of Viral Hepatitis, 1, 3-5). Examples of influenza-like symptoms include fatigue, fever, myalgia, malaise, appetite loss, tachycardia, rigors, headache, and arthralgias. The influenza-like symptoms are usually short-lived and tend to abate after the first four weeks of dosing (Dushieko et al., supra). Neuropsychiatric side effects include irritability, apathy, mood changes, insomnia, cognitive changes, and depression. The most important of these neuropsychiatric side effects is depression and patients who have a history of depression should not be given type 1 interferon. Laboratory abnormalities include reduction in myeloid cells, including granulocytes, platelets and to a lesser extent red blood cells. These changes in blood cell counts rarely lead to any significant clinical sequelae (Dushieko et al., supra). In addition, increases in triglyceride concentrations and elevations in serum alanine and aspartate aminotransferase concentration have been observed. Finally, thyroid abnormalities have been reported. These thyroid abnormalities are usually reversible after cessation of interferon therapy and can be controlled with appropriate medication while on therapy. Miscellaneous side effects include nausea, diarrhea, abdominal and back pain, pruritus, alopecia, and rhinorrhea. In general, most side effects will abate after 4 to 8 weeks of therapy (Dushieko et al., supra).

The use of small interfering nucleic acid molecules targeting HCV genes therefore provides a class of novel therapeutic agents that can be used in the treatment and diagnosis of HCV infection, liver failure, hepatocellular carcinoma, cirrhosis or any other disease or condition that responds to modulation of HCV genes.

EXAMPLES

The following are non-limiting examples showing the selection, isolation, synthesis and activity of nucleic acids of the instant invention.

Example 1

Tandem Synthesis of siNA Constructs

Exemplary siNA molecules of the invention are synthesized in tandem using a cleavable linker, for example a succinyl-based linker. Tandem synthesis as described herein is followed by a one-step purification process that provides RNAi molecules in high yield. This approach is highly amenable to siNA synthesis in support of high throughput RNAi screening, and can be readily adapted to multi-column or multi-well synthesis platforms.

After completing a tandem synthesis of an siNA oligo and its complement in which the 5'-terminal dimethoxytrityl (5'-O-DMT) group remains intact (trityl on synthesis), the oligonucleotides are deprotected as described above. Following deprotection, the siNA sequence strands are allowed to spontaneously hybridize. This hybridization yields a duplex in which one strand has retained the 5'-O-DMT group while the complementary strand comprises a terminal 5'-hydroxyl. The newly formed duplex behaves as a single molecule during routine solid-phase extraction purification (Trityl-On purification) even though only one molecule has a dimethoxytrityl group. Because the strands form a stable duplex, this dimethoxytrityl group (or an equivalent group, such as other trityl groups or other hydrophobic moieties) is all that is required to purify the pair of oligos, for example by using a C18 cartridge.

Standard phosphoramidite synthesis chemistry is used up to the point of introducing a tandem linker, such as an inverted deoxy abasic succinate or glyceryl succinate linker (see FIG. 1) or an equivalent cleavable linker. A non-limiting example of linker coupling conditions that can be used includes a hindered base such as diisopropylethylamine (DIPA) and/or DMAP in the presence of an activator reagent such as Bromotripyrrolidinophosphoniumhexafluororophosphate (PyBrOP). After the linker is coupled, standard synthesis chemistry is utilized to complete synthesis of the second sequence leaving the terminal the 5'-O-DMT intact. Following synthesis, the resulting oligonucleotide is deprotected according to the procedures described herein and quenched with a suitable buffer, for example with 50 mM NaOAc or 1.5M $NH_4H_2CO_3$.

Purification of the siNA duplex can be readily accomplished using solid phase extraction, for example using a Waters C18 SepPak 1 g cartridge conditioned with 1 column volume (CV) of acetonitrile, 2 CV H2O, and 2 CV 50 mM NaOAc. The sample is loaded and then washed with 1 CV H2O or 50 mM NaOAc. Failure sequences are eluted with 1 CV 14% ACN (Aqueous with 50 mM NaOAc and 50 mM NaCl). The column is then washed, for example with 1 CV H2O followed by on-column detritylation, for example by passing 1 CV of 1% aqueous trifluoroacetic acid (TFA) over the column, then adding a second CV of 1% aqueous TFA to the column and allowing to stand for approximately 10 minutes. The remaining TFA solution is removed and the column washed with H20 followed by 1 CV 1M NaCl and additional H2O. The siNA duplex product is then eluted, for example using 1 CV 20% aqueous CAN.

Figure 2:
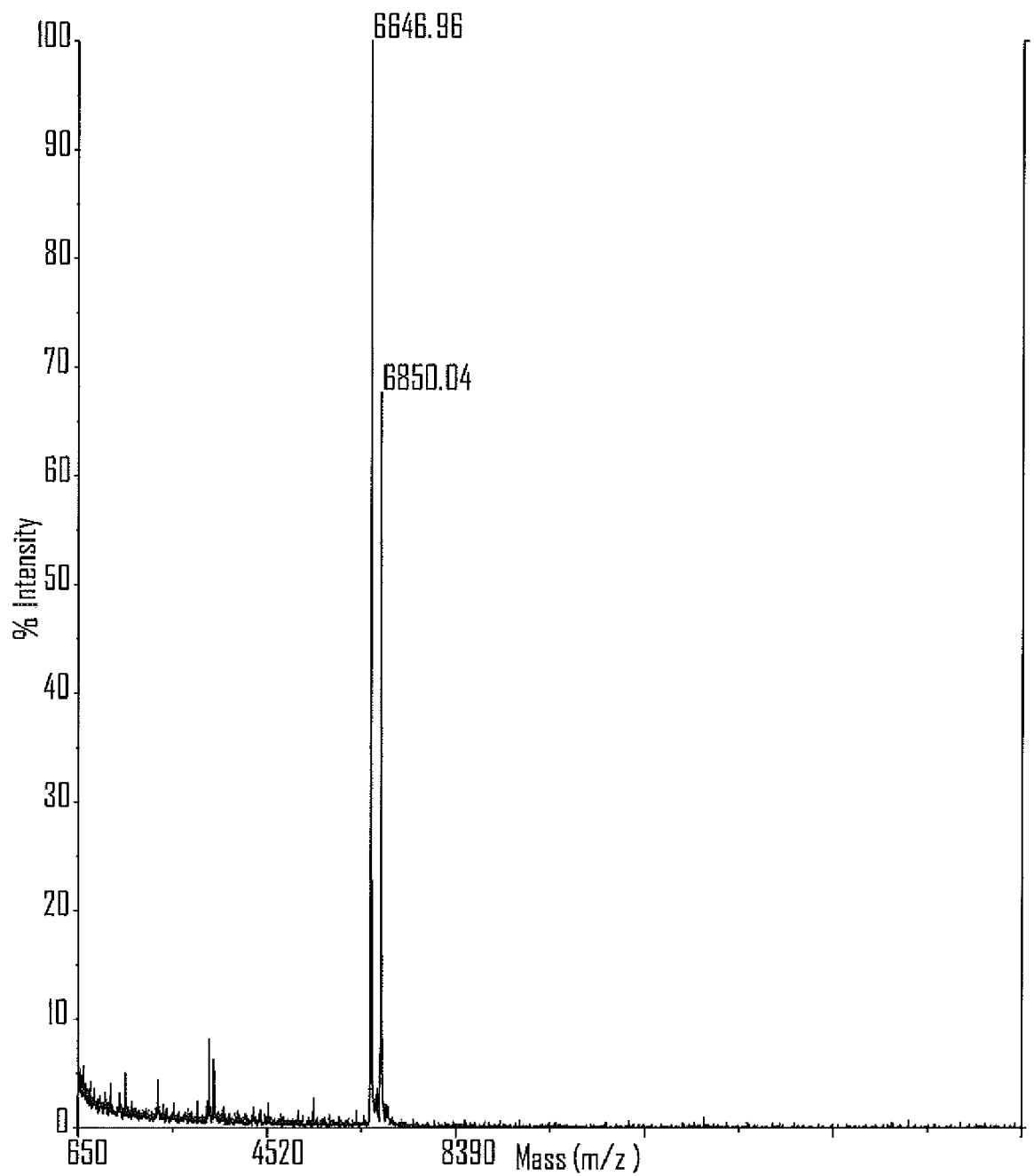
FIG. 2 shows a MALDI-TOF mass spectrum of a purified siNA duplex synthesized by a method of the invention. The two peaks shown correspond to the predicted mass of the separate siNA sequence strands. This result demonstrates that the siNA duplex generated from tandem synthesis can be purified as a single entity using a simple trityl-on purification methodology.
Figure 3:
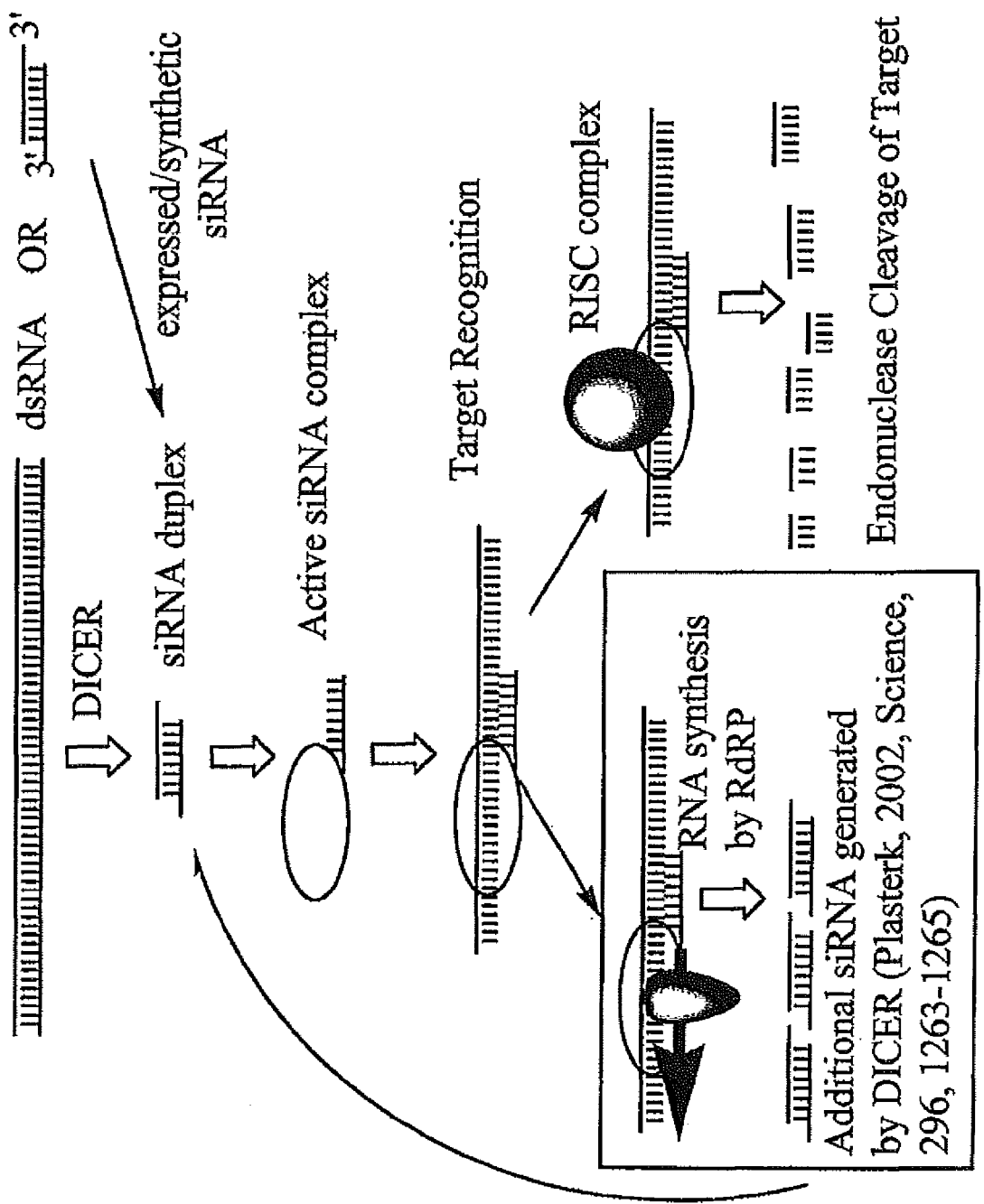
FIG. 3 shows a non-limiting proposed mechanistic representation of target RNA degradation involved in RNAi. Double-stranded RNA (dsRNA), which is generated by RNA-dependent RNA polymerase (RdRP) from foreign single-stranded RNA, for example viral, transposon, or other exogenous RNA, activates the DICER enzyme that in turn generates siNA duplexes. Alternately, synthetic or expressed siNA can be introduced directly into a cell by appropriate means. An active siNA complex forms, which recognizes a target RNA, resulting in degradation of the target RNA by the RISC endonuclease complex or in the synthesis of additional RNA by RNA-dependent RNA polymerase (RdRP), which can activate DICER and result in additional siNA molecules, thereby amplifying the RNAi response.
Figure 5:
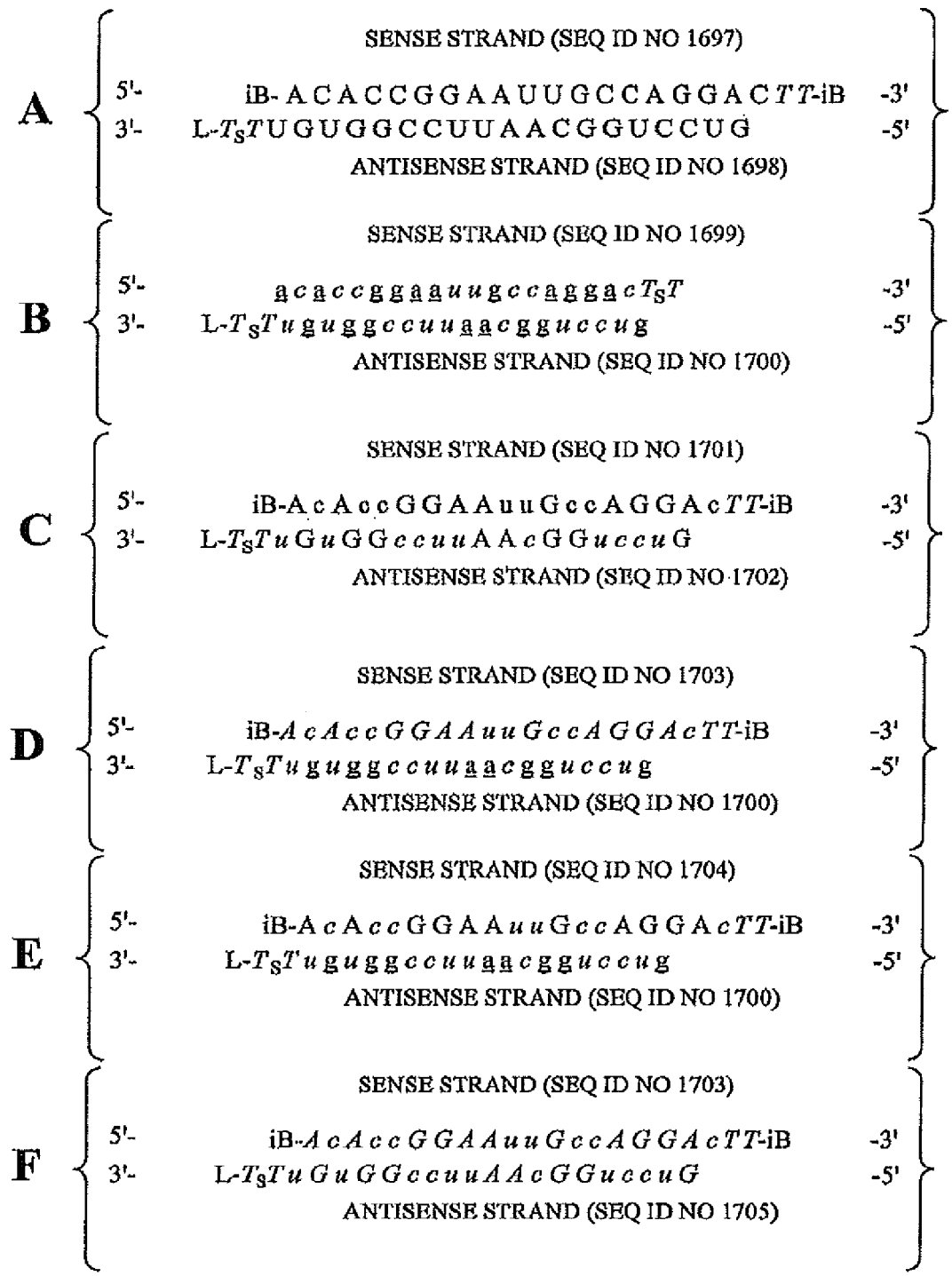
FIG. 5A-F shows non-limiting examples of specific chemically modified siNA sequences of the invention. A-F applies the chemical modifications described in FIG. 4A-F to an HCV siNA sequence.
Figure 6:
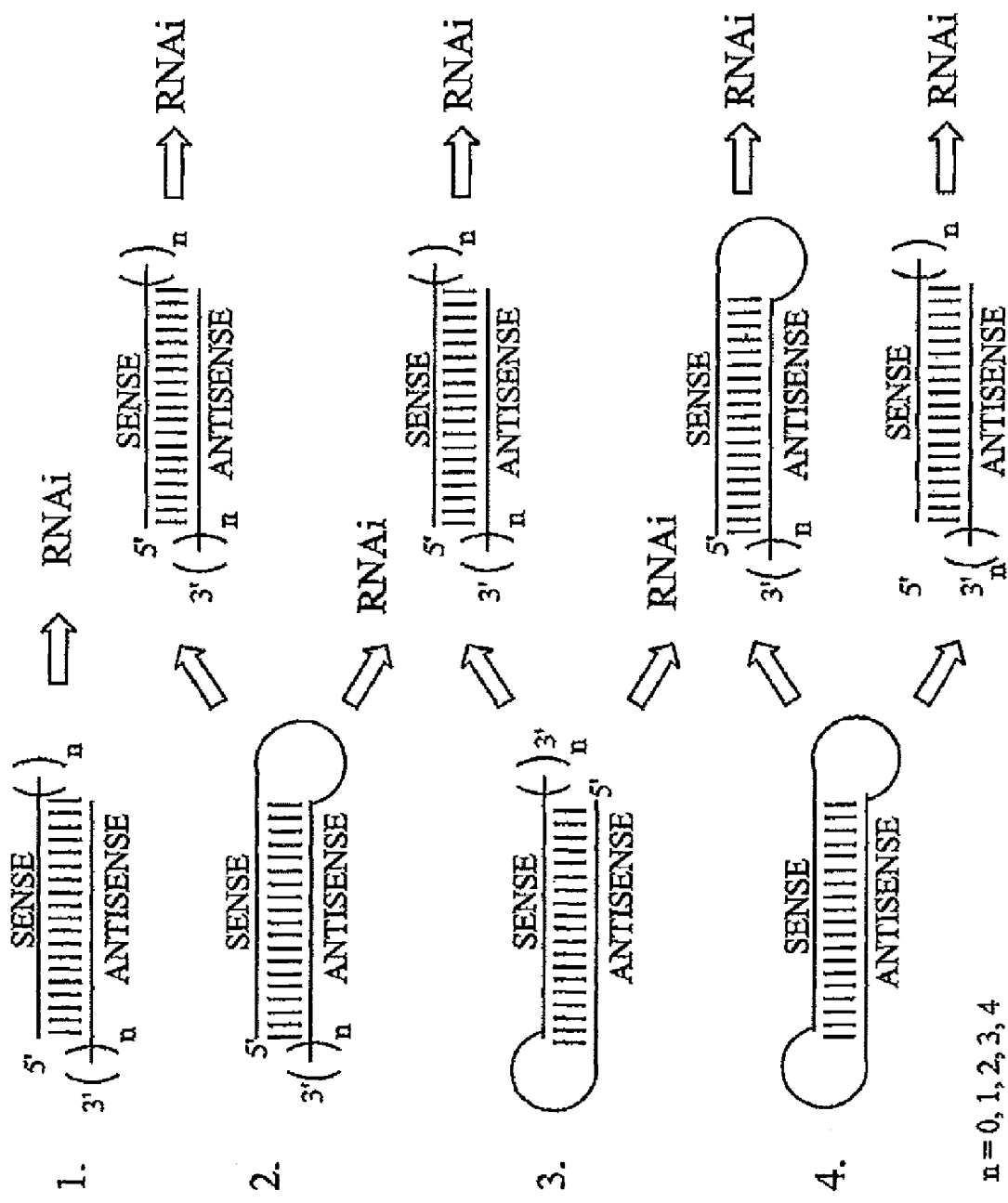
FIG. 6 shows non-limiting examples of different siNA constructs of the invention. The examples shown (constructs 1, 2, and 3) have 19 representative base pairs; however, different embodiments of the invention include any number of base pairs described herein. Bracketed regions represent nucleotide overhangs, for example comprising about 1, 2, 3, or 4 nucleotides in length, preferably about 2 nucleotides. Constructs 1 and 2 can be used independently for RNAi activity. Construct 2 can comprise a polynucleotide or non-nucleotide linker, which can optionally be designed as a biodegradable linker. In one embodiment, the loop structure shown in construct 2 can comprise a biodegradable linker that results in the formation of construct 1 in vivo and/or in vitro.

FIG. 2 provides an example of MALDI-TOF mass spectrometry analysis of a purified siNA construct in which each peak corresponds to the calculated mass of an individual siNA strand of the siNA duplex. The same purified siNA provides three peaks when analyzed by capillary gel electrophoresis (CGE), one peak presumably corresponding to the duplex siNA, and two peaks presumably corresponding to the separate siNA sequence strands. Ion exchange HPLC analysis of the same siNA contract only shows a single peak. Testing of the purified siNA construct using a luciferase reporter assay described below demonstrated the same RNAi activity compared to siNA constructs generated from separately synthesized oligonucleotide sequence strands.

Example 2

Identification of Potential siNA Target Sites in Any RNA Sequence

The sequence of an RNA target of interest, such as a viral or human mRNA transcript, is screened for target sites, for example by using a computer folding algorithm. In a non-limiting example, the sequence of a gene or RNA gene transcript derived from a database, such as Genbank, is used to generate siNA targets having complementarity to the target. Such sequences can be obtained from a database, or can be determined experimentally as known in the art. Target sites that are known, for example, those target sites determined to be effective target sites based on studies with other nucleic acid molecules, for example ribozymes or antisense, or those targets known to be associated with a disease or condition such as those sites containing mutations or deletions, can be used to design siNA molecules targeting those sites. Various parameters can be used to determine which sites are the most suitable target sites within the target RNA sequence. These parameters include but are not limited to secondary or tertiary RNA structure, the nucleotide base composition of the target sequence, the degree of homology between various regions of the target sequence, or the relative position of the target sequence within the RNA transcript. Based on these determinations, any number of target sites within the RNA transcript can be chosen to screen siNA molecules for efficacy, for example by using in vitro RNA cleavage assays, cell culture, or animal models. In a non-limiting example, anywhere from 1 to 1000 target sites are chosen within the transcript based on the size of the siNA construct to be used. High throughput screening assays can be developed for screening siNA molecules using methods known in the art, such as with multi-well or multi-plate assays to determine efficient reduction in target gene expression.

Example 3

Selection of siNA Molecule Target Sites in a RNA

The following non-limiting steps can be used to carry out the selection of siNAs targeting a given gene sequence or transcript.

1. The target sequence is parsed in silico into a list of all fragments or subsequences of a particular length, for example 23 nucleotide fragments, contained within the target sequence. This step is typically carried out using a custom Perl script, but commercial sequence analysis programs such as Oligo, MacVector, or the GCG Wisconsin Package can be employed as well.

2. In some instances the siNAs correspond to more than one target sequence; such would be the case for example in targeting different transcripts of the same gene, targeting different transcripts of more than one gene, or for targeting both the human gene and an animal homolog. In this case, a subsequence list of a particular length is generated for each of the targets, and then the lists are compared to find matching sequences in each list. The subsequences are then ranked according to the number of target sequences that contain the given subsequence; the goal is to find subsequences that are present in most or all of the target sequences. Alternately, the ranking can identify subsequences that are unique to a target sequence, such as a mutant target sequence. Such an approach would enable the use of siNA to target specifically the mutant sequence and not effect the expression of the normal sequence.

3. In some instances the siNA subsequences are absent in one or more sequences while present in the desired target sequence; such would be the case if the siNA targets a gene with a paralogous family member that is to remain untargeted. As in case 2 above, a subsequence list of a particular length is generated for each of the targets, and then the lists are compared to find sequences that are present in the target gene but are absent in the untargeted paralog.

4. The ranked siNA subsequences can be further analyzed and ranked according to GC content. A preference can be given to sites containing 30-70% GC, with a further preference to sites containing 40-60% GC.

5. The ranked siNA subsequences can be further analyzed and ranked according to self-folding and internal hairpins. Weaker internal folds are preferred; strong hairpin structures are to be avoided.

6. The ranked siNA subsequences can be further analyzed and ranked according to whether they have runs of GGG or CCC in the sequence. GGG (or even more Gs) in either strand can make oligonucleotide synthesis problematic and can potentially interfere with RNAi activity, so it is avoided whenever better sequences are available. CCC is searched in the target strand because that will place GGG in the antisense strand.

7. The ranked siNA subsequences can be further analyzed and ranked according to whether they have the dinucleotide UU (uridine dinucleotide) on the 3'-end of the sequence, and/or AA on the 5'-end of the sequence (to yield 3' UU on the antisense sequence). These sequences allow one to design siNA molecules with terminal TT thymidine dinucleotides.

8. Four or five target sites are chosen from the ranked list of subsequences as described above. For example, in subsequences having 23 nucleotides, the right 21 nucleotides of each chosen 23-mer subsequence are then designed and synthesized for the upper (sense) strand of the siNA duplex, while the reverse complement of the left 21 nucleotides of each chosen 23-mer subsequence are then designed and synthesized for the lower (antisense) strand of the siNA duplex (see Tables II and III). If terminal TT residues are desired for the sequence (as described in paragraph 7), then the two 3' terminal nucleotides of both the sense and antisense strands are replaced by TT prior to synthesizing the oligos.

9. The siNA molecules are screened in an in vitro, cell culture or animal model system to identify the most active siNA molecule or the most preferred target site within the target RNA sequence.

Figure 9:
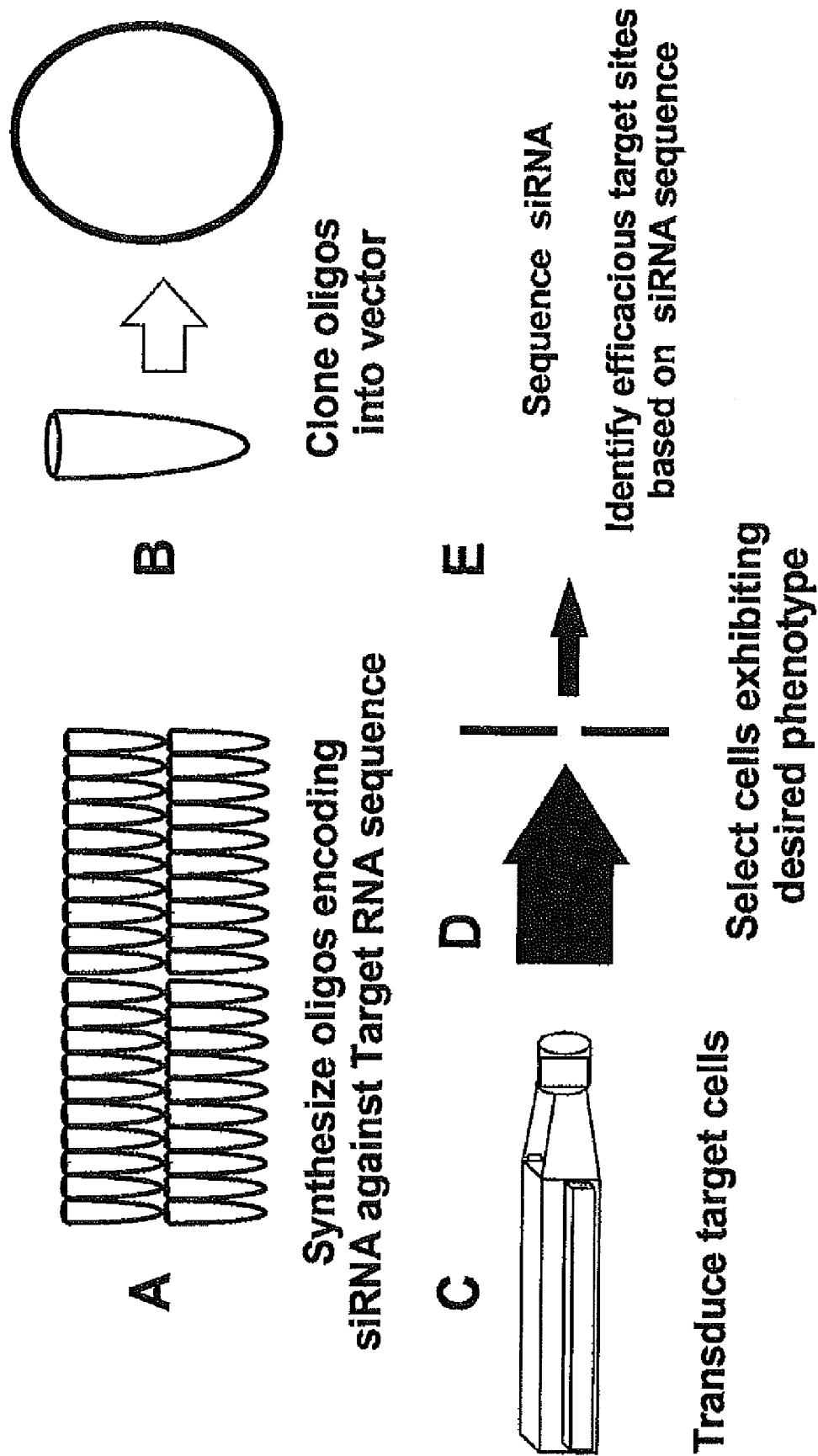

In an alternate approach, a pool of siNA constructs specific to an HCV target sequence is used to screen for target sites in cells expressing HCV RNA, such as the human hepatoma (Huh7) cells (see for example Randall et al., 2003, *PNAS USA*, 100, 235-240). The general strategy used in this approach is shown in FIG. 9. A non-limiting example of such is a pool comprising sequences having sequences comprising SEQ ID NOS: 1-1681. Cells expressing HCV (e.g., Huh7 cells) are transfected with the pool of siNA constructs and cells that demonstrate a phenotype associated with HCV inhibition are sorted. The pool of siNA constructs can be expressed from transcription cassettes inserted into appropriate vectors (see for example FIG. 7 and FIG. 8). The siNA from cells demonstrating a positive phenotypic change (e.g., decreased proliferation, decreased HCV mRNA levels or decreased HCV protein expression), are sequenced to determine the most suitable target site(s) within the target HCV RNA sequence.

Example 4

HCV Targeted siNA Design siNA target sites were chosen by analyzing sequences of the HCV RNA target and optionally prioritizing the target sites on the basis of folding (structure of any given sequence analyzed to determine siNA accessibility to the target), by using a library of siNA molecules as described in Example 3, or alternately by using an in vitro siNA system as described in Example 6 herein. siNA molecules were designed that could bind each target and are optionally individually analyzed by computer folding to assess whether the siNA molecule can interact with the target sequence. Varying the length of the siNA molecules can be done to optimize activity. Generally, a sufficient number of complementary nucleotide bases are chosen to bind to, or otherwise interact with, the target RNA, but the degree of complementarity can be modulated to accommodate siNA duplexes or varying length or base composition. By using such methodologies, siNA molecules can be designed to target sites within any known RNA sequence, for example those RNA sequences corresponding to the any gene transcript.

Chemically modified siNA constructs are designed to provide nuclease stability for systemic administration in vivo and/or improved pharmacokinetic, localization, and delivery properties while preserving the ability to mediate RNAi activity. Chemical modifications as described herein are introduced synthetically using synthetic methods described herein and those generally known in the art. The synthetic siNA constructs are then assayed for nuclease stability in serum and/or cellular/tissue extracts (e.g. liver extracts). The synthetic siNA constructs are also tested in parallel for RNAi activity using an appropriate assay, such as a luciferase reporter assay as described herein or another suitable assay that can quantity RNAi activity. Synthetic siNA constructs that possess both nuclease stability and RNAi activity can be further modified and re-evaluated in stability and activity assays. The chemical modifications of the stabilized active siNA constructs can then be applied to any siNA sequence targeting any chosen RNA and used, for example, in target screening assays to pick lead siNA compounds for therapeutic development (see for example FIG. 11).

Example 5

Chemical Synthesis and Purification of siNA siNA molecules can be designed to interact with various sites in the RNA message, for example, target sequences within the RNA sequences described herein. The sequence of one strand of the siNA molecule(s) is complementary to the target site sequences described above. The siNA molecules can be chemically synthesized using methods described herein. Inactive siNA molecules that are used as control sequences can be synthesized by scrambling the sequence of the siNA molecules such that it is not complementary to the target sequence. Generally, siNA constructs can by synthesized using solid phase oligonucleotide synthesis methods as described herein (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086 all incorporated by reference herein in their entirety).

In a non-limiting example, RNA oligonucleotides are synthesized in a stepwise fashion using the phosphoramidite chemistry as is known in the art. Standard phosphoramidite chemistry involves the use of nucleosides comprising any of 5'-O-dimethoxytrityl, 2'-O-tert-butyldimethylsilyl, 3'-O-2-cyanoethyl N,N-diisopropylphos-phoroamidite groups, and exocyclic amine protecting groups (e.g. N6-benzoyl adenosine, N4 acetyl cytidine, and N2-isobutyryl guanosine). Alternately, 2'-O-silyl ethers can be used in conjunction with acid-labile 2'-O-orthoester protecting groups in the synthesis of RNA as described by Scaringe supra. Differing 2' chemistries can require different protecting groups, for example 2'-deoxy-2'-amino nucleosides can utilize N-phthaloyl protection as described by Usman et al., U.S. Pat. No. 5,631,360, incorporated by reference herein in its entirety.

During solid phase synthesis, each nucleotide is added sequentially (3'- to 5'-direction) to the solid support-bound oligonucleotide. The first nucleotide at the 3'-end of the chain is covalently attached to a solid support (e.g., controlled pore glass or polystyrene) using various linkers. The nucleotide precursor, a ribonucleoside phosphoramidite, and activator are combined resulting in the coupling of the second nucleoside phosphoramidite onto the 5'-end of the first nucleoside. The support is then washed and any unreacted 5'-hydroxyl groups are capped with a capping reagent such as acetic anhydride to yield inactive 5'-acetyl moieties. The trivalent phosphorus linkage is then oxidized to a more stable phosphate linkage. At the end of the nucleotide addition cycle, the 5'-O-protecting group is cleaved under suitable conditions (e.g., acidic conditions for trityl-based groups and fluoride for silyl-based groups). The cycle is repeated for each subsequent nucleotide.

Modification of synthesis conditions can be used to optimize coupling efficiency, for example by using differing coupling times, differing reagent/phosphoramidite concentrations, differing contact times, differing solid supports and solid support linker chemistries depending on the particular chemical composition of the siNA to be synthesized. Deprotection and purification of the siNA can be performed as is generally described in Usman et al., U.S. Pat. No. 5,831,071, U.S. Pat. No. 6,353,098, U.S. Pat. No. 6,437,117, Bellon et al., U.S. Pat. No. 6,054,576, U.S. Pat. No. 6,162,909, U.S. Pat. No. 6,303,773, and Scaringe supra, all of which are incorporated by reference herein in their entireties. Additionally, deprotection conditions can be modified to provide the best possible yield and purity of siNA constructs. For example, applicant has observed that oligonucleotides comprising 2'-deoxy-2'-fluoro nucleotides can degrade under inappropriate deprotection conditions. Such oligonucleotides are deprotected using aqueous methylamine at about 35° C. for 30 minutes. If the 2'-deoxy-2'-fluoro containing oligonucleotide also comprises ribonucleotides, after deprotection with aqueous methylamine at about 35° C. for 30 minutes, TEA-HF is added and the reaction maintained at about 65° C. for an additional 15 minutes.

Example 6

RNAi In Vitro Assay to Assess siNA Activity

An in vitro assay that recapitulates RNAi in a cell-free system is used to evaluate siNA constructs targeting HCV RNA targets. The assay comprises the system described by Tuschl et al., 1999, *Genes and Development,* 13, 3191-3197 and Zamore et al., 2000, *Cell,* 101, 25-33 adapted for use with HCV target RNA. A *Drosophila* extract derived from syncytial blastoderm is used to reconstitute RNAi activity in vitro. Target RNA is generated via in vitro transcription from an appropriate HCV expressing plasmid using T7 RNA polymerase or via chemical synthesis as described herein. Sense and antisense siNA strands (for example 20 uM each) are annealed by incubation in buffer (such as 100 mM potassium acetate, 30 mM HEPES-KOH, pH 7.4, 2 mM magnesium acetate) for 1 min. at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechlorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing siNA (10 nM final concentration). The reaction mixture also contains 10 mM creatine phosphate, 10 ug·ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which siNA is omitted from the reaction.

Alternately, internally-labeled target RNA for the assay is prepared by in vitro transcription in the presence of [alpha-$^{32}$P] CTP, passed over a G 50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by Phosphor Imager® quantitation of bands representing intact control RNA or RNA from control reactions without siNA and the cleavage products generated by the assay.

In one embodiment, this assay is used to determine target sites of the HCV RNA target for siNA mediated RNAi cleavage, wherein a plurality of siNA constructs are screened for RNAi mediated cleavage of the HCV RNA target, for example, by analyzing the assay reaction by electrophoresis of labeled target RNA, or by Northern blotting, as well as by other methodology well known in the art.

Example 7

Nucleic Acid Inhibition of HCV Target RNA In Vivo siNA molecules targeted to the human HCV RNA are designed and synthesized as described above. These nucleic acid molecules can be tested for cleavage activity in vivo, for example, using the following procedure. The target sequences and the nucleotide location within the HCV RNA are given in Table II and III.

Two formats are used to test the efficacy of siNAs targeting HCV. First, the reagents are tested in cell culture using, for example, Huh7 cells (see, for example, Randall et al., 2003, *PNAS USA,* 100, 235-240) to determine the extent of RNA and protein inhibition. siNA reagents (e.g.; see Tables II and III) are selected against the HCV target as described herein. RNA inhibition is measured after delivery of these reagents by a suitable transfection agent to, for example, Huh7 cells. Relative amounts of target RNA are measured versus actin using real-time PCR monitoring of amplification (e.g., ABI 7700 Taqman®). A comparison is made to a mixture of oligonucleotide sequences made to unrelated targets or to a randomized siNA control with the same overall length and chemistry, but randomly substituted at each position. Primary and secondary lead reagents are chosen for the target and optimization is performed. After an optimal transfection agent concentration is chosen, a RNA time-course of inhibition is performed with the lead siNA molecule.

In addition, a cell-plating format can be used to determine RNA inhibition. A non-limiting example of a multiple target screen to assay siNA mediated inhibition of HCV RNA is shown in FIG. 18. siNA constructs (Table III) were transfected at 25 nM into Huh7 cells and HCV RNA quantitated compared to untreated cells ("cells" column in the figure) and cells transfected with lipofectamine ("LFA2K" column in the figure). As shown in FIG. 18, several siNA constructs show significant inhibition of HCV RNA expression in the Huh7 replicon system. This system is described in Rice et al., U.S. Pat. No. 5,874,565 and U.S. Pat. No. 6,127,116, both incorporated by reference herein.

Delivery of siNA to Cells

Huh7b cells stably transfected with the HCV subgenomic replicon Clone A or Ava.5 are seeded, for example, at $8.5 \times 10^3$ cells per well of a 96-well platein DMEM(Gibco) the day before transfection. siNA (final concentration, for example 25 nM) and cationic lipid Lipofectamine2000 (e.g., final concentration 0.5 ul/well) are complexed in Optimem (Gibco) at 37° C. for 20 minutes inpolypropelyne microtubes. Following vortexing, the complexed siNA is added to each well and incubated for 24-72 hours.

Taqman Quantification of mRNA

Total RNA is prepared from cells following siNA delivery, for example, using Ambion Rnaqueous 4-PCR purification kit for large scale extractions, or Ambion Rnaqueous-96 purification kit for 96-well assays. For Taqman analysis, dual-labeled probes are synthesized with, for example, the reporter dyes FAM or VIC covalently linked at the 5'-end and the quencher dye TAMARA conjugated to the 3'-end. One-step RT-PCR amplifications are performed on, for example, an ABI PRISM 7700 Sequence detector using 50 uL reactions consisting of 10 uL total RNA, 100 nM forward primer, 100 nM reverse primer, 100 nM probe, 1X TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target mRNA level is determined relative to standards generated from serially diluted total cellular RNA (300, 100, 30, 10 ng/rxn) and normalizing to, for example, 36B4 mRNA in either parallel or same tube TaqMan reactions. For HCV Replicon mRNA quantitation, PCR primers and probe specific for the neomycin gene were used:

```
neo-forward primer,
                                    (SEQ ID NO: 1682)
5'-CCGGCTACCTGCCCATTC-3';

neo-reverse primer,
                                    (SEQ ID NO: 1683)
5'-CCAGATCATCCTGATCGACAAG-3';

neo-probe,
                                    (SEQ ID NO: 1684)
5'FAM-ACATCGCATCGAGCGAGCACGTAC-TAMARA3';

For normalization, 36B4 PCR primers and probe
were used:
36B4-forward primer,
                                    (SEQ ID NO: 1685)
5'-TCTATCATCAACGGGTACAAACGA-3';

36B4 reverse primer,
                                    (SEQ ID NO: 1686)
5'-CTTTTCAGCAAGTGGGAAGGTG-3';

36B4 probe,
                                    (SEQ ID NO: 1687)
5'VIC-CCTGGCCTTGTCTGTGGAGACGGATTA-TAMARA3';
```

Western Blotting

Nuclear extracts can be prepared using a standard micro preparation technique (see for example Andrews and Faller, 1991, *Nucleic Acids Research,* 19, 2499). Protein extracts from supernatants are prepared, for example using TCA precipitation. An equal volume of 20% TCA is added to the cell supernatant, incubated on ice for 1 hour and pelleted by centrifugation for 5 minutes. Pellets are washed in acetone, dried and resuspended in water. Cellular protein extracts are run on a 10% Bis-Tris NuPage (nuclear extracts) or 4-12% Tris-Glycine (supernatant extracts) polyacrylamide gel and transferred onto nitro-cellulose membranes. Non-specific binding can be blocked by incubation, for example, with 5% non-fat milk for 1 hour followed by primary antibody for 16 hour at 4° C. Following washes, the secondary antibody is applied, for example (1:10,000 dilution) for 1 hour at room temperature and the signal detected with SuperSignal reagent (Pierce).

Example 8

Models Useful to Evaluate the Down-Regulation of HCV Gene Expression

Cell Culture

Although there have been reports of replication of HCV in cell culture (see below), these systems are difficult to reproduce and have proven unreliable. Therefore, as was the case for development of other anti-HCV therapeutics, such as interferon and ribavirin, after demonstration of safety in animal studies, applicant can proceed directly into a clinical feasibility study.

Several recent reports have documented in vitro growth of HCV in human cell lines (Mizutani et al., Biochem Biophys Res Commun 1996 227(3):822-826; Tagawa et al., Journal of Gasteroenterology and Hepatology 1995 10(5):523-527; Cribier et al., *Journal of General Virology* 76(10):2485-2491; Seipp et al., *Journal of General Virology* 1997 78(10)2467-2478; Iacovacci et al., Research Virology 1997 148(2):147-151; Iocavacci et al., Hepatology 1997 26(5) 1328-1337; Ito et al., Journal of General Virology 1996 77(5): 1043-1054; Nakajima et al., *Journal of Virology* 1996 70(5):3325-3329; Mizutani et al., *Journal of Virology* 1996 70(10):7219-7223; Valli et al., *Res Virol* 1995 146(4): 285-288; Kato et al., *Biochem Biophys Res Comm* 1995 206(3):863-869). Replication of HCV has been reported in both T and B cell lines, as well as cell lines derived from human hepatocytes. Detection of low level replication was documented using either RT-PCR based assays or the b-DNA assay. It is important to note that the most recent publications regarding HCV cell cultures document replication for up to 6-months. However, the level of HCV replication observed in these cell lines has not been robust enough for screening of antiviral compounds.

In addition to cell lines that can be infected with HCV, several groups have reported the successful transformation of cell lines with cDNA clones of full-length or partial HCV genomes (Harada et al., Journal of General Virology, 1995, 76(5)1215-1221; Haramatsu et al., Journal of Viral Hepatitis 1997 4S(1):61-67; Dash et al., American Journal of Pathology 1997 151(2):363-373; Mizuno et al., Gasteroenterology 1995 109(6):1933-40; Yoo et al., Journal Of Virology 1995 69(1):32-38).

The recent development of subgenomic HCV RNA replicons, capable of successfully replicating in the human hepatoma cell line, Huh7, represents a significant advance toward a dependable cell culture model. These replicons contain the neomycin gene upstream of the HCV nonstructural genes allowing for the selection of replicative RNAs in Huh7 cells. Initially, RNA replication was detected at a low frequency (Lohmann et al. Science 1999 285: 110-113) but the identification of replicons with cell-adaptive mutations in the NS5A region has improved the efficiency of replication 10.000-fold (Blight et al. Science 2000 290:1972-1975). Steps in the HCV life cycle, such as translation, protein processing, and RNA replication are recapitulated in the subgenomic replicon systems, but early events (viral attachment and uncoating) and viral assembly is absent. Inclusion of the structural genes of HCV within the replicons results in the production of HCV core and envelope proteins, but virus assembly does not occur (Pietschmann et al. Journal of Virology 2002 76: 4008-4021). Such replicon systems have been used to study siRNA mediated inhibition of HCV RNA, see for example, Randall et al., 2003, *PNAS USA*, 100, 235-240.

In several cell culture systems, cationic lipids have been shown to enhance the bioavailability of oligonucleotides to cells in culture (Bennet, et al., 1992, *Mol. Pharmacology*, 41, 1023-1033). In one embodiment, siNA molecules of the invention are complexed with cationic lipids for cell culture experiments. siNA and cationic lipid mixtures are prepared in serum-free DMEM immediately prior to addition to the cells. DMEM plus additives are warmed to room temperature (about 20-25° C.) and cationic lipid is added to the final desired concentration and the solution is vortexed briefly. siNA molecules are added to the final desired concentration and the solution is again vortexed briefly and incubated for 10 minutes at room temperature. In dose response experiments, the RNA/lipid complex is serially diluted into DMEM following the 10 minute incubation.

Animal Models

Evaluating the efficacy of anti-HCV agents in animal models is an important prerequisite to human clinical trials. The best characterized animal system for HCV infection is the chimpanzee. Moreover, the chronic hepatitis that results from HCV infection in chimpanzees and humans is very similar. Although clinically relevant, the chimpanzee model suffers from several practical impediments that make use of this model difficult. These include high cost, long incubation requirements and lack of sufficient quantities of animals. Due to these factors, a number of groups have attempted to develop rodent models of chronic hepatitis C infection. While direct infection has not been possible, several groups have reported on the stable transfection of either portions or entire HCV genomes into rodents (Yamamoto et al., Hepatology 1995 22(3): 847-855; Galun et al., Journal of Infectious Disease 1995 172(1):25-30; Koike et al., Journal of general Virology 1995 76(12)3031-3038; Pasquinelli et al., Hepatology 1997 25(3): 719-727; Hayashi et al., Princess Takamatsu Symp 1995 25:1430149; Mariya et al., Journal of General Virology 1997 78(7) 1527-1531; Takehara et al., Hepatology 1995 21(3):746-751; Kawamura et al., Hepatology 1997 25(4): 1014-1021). In addition, transplantation of HCV infected human liver into immunocompromised mice results in prolonged detection of HCV RNA in the animal's blood.

A method for expressing hepatitis C virus in an in vivo animal model has been developed (Vierling, International PCT Publication No. WO 99/16307). Viable, HCV infected human hepatocytes are transplanted into a liver parenchyma of a scid/scid mouse host. The scid/scid mouse host is then maintained in a viable state, whereby viable, morphologically intact human hepatocytes persist in the donor tissue and hepatitis C virus is replicated in the persisting human hepatocytes. This model provides an effective means for the study of HCV inhibition by enzymatic nucleic acids in vivo.

Example 9

RNAi Mediated Inhibition of HCV RNA Expression siNA constructs (e.g., siNA constructs shown in Table III) are tested for efficacy in reducing HCV RNA expression in, for example, Huh7 cells (see, for example, Randall et al., 2003, *PNAS USA*, 100, 235-240). Cells are plated approximately 24 hours before transfection in 96-well plates at 5,000-7,500 cells/well, 100 μl/well, such that at the time of transfection cells are 70-90% confluent. For transfection, annealed siNAs are mixed with the transfection reagent (Lipofectamine 2000, Invitrogen) in a volume of 50 μwell and incubated for 20 minutes at room temperature. The siNA transfection mixtures are added to cells to give a final siNA concentration of 25 nM in a volume of 150 μl. Each siNA transfection mixture is added to 3 wells for triplicate siNA treatments. Cells are incubated at 37° for 24 hours in the continued presence of the siNA transfection mixture. At 24 hours, RNA is prepared from each well of treated cells. The supernatants with the transfection mixtures are first removed and discarded, then the cells are lysed and RNA prepared from each well. Target gene expression following treatment is evaluated by RT-PCR for the target gene and for a control gene (36B4, an RNA polymerase subunit) for normalization. The triplicate data is averaged and the standard deviations determined for each treatment. Normalized data are graphed and the percent reduction of target mRNA by active siNAs in comparison to their respective inverted control siNAs is determined.

In a non-limiting example, an siNA construct comprising ribonucleotides and 3'-terminal dithymidine caps is assayed along with a chemically modified siNA construct comprising 2'-deoxy-2'-fluoro pyrimidine nucleotides and purine ribonucleotides in which the sense strand of the siNA is further modified with 5' and 3'-terminal inverted deoxyabasic caps and the antisense strand comprises a 3'-terminal phosphorothioate internucleotide linkage. Additional stabilization chemistries as described in Table IV are similarly assayed for activity. These siNA constructs are compared to appropriate matched chemistry inverted controls. In addition, the siNA constructs are also compared to untreated cells, cells transfected with lipid and scrambled siNA constructs, and cells transfected with lipid alone (transfection control).

Example 10 siNA Inhibition of a Chimeric HCV/Poliovirus in HeLa Cells

Inhibition of a chimeric HCV/Poliovirus was investigated using 21 nucleotide siNA duplexes in HeLa cells. Seven siNA were designed that target three regions in the highly conserved 5' untranslated region (UTR) of HCV RNA. The siNAs were screened in two cell culture systems dependent upon the 5'-UTR of HCV; one requires translation of an HCV/luciferase gene, while the other involves replication of a chimeric HCV/poliovirus (PV) (see Blatt et al., U.S. Ser. No. 09/740,332, filed Dec. 18, 2000, incorporated by reference herein). Transfection for the HCV/PV system was performed in HeLa cells (grown in DMEM supplemented with sodium pyruvate and 100 mM HEPES with 5% FBS) using either cationic lipid NC168 or LFA2K, with an siNA concentration of 10 nM or 25 nM. HeLa cells were innoculated with HCV/PV virus at an moi=0.01 pfu/cell for 30 minutes in serum-free media. The innoculum was removed and 80 μL media was added, with 20 μL of transfection complex added to each well. The cells and supernatants were frozen at 20-24 hours post transfection. Each plate underwent 3 freeze-thaw cycles and the supernatant was collected. The supernatant was titered on HeLa cells for 3 days, then stained and counted. The results shown in FIGS. 14-17 are reported as pfu/ml×$10^5$.

Two siNAs (29579/29586 and 29578/2958) targeting the same region (shifted by one nucleotide) are active in both systems (see FIG. 12). For example, a >85% reduction in HCVPV replication was observed in siNA-treated cells compared to an inverse siNA control 29593/29600 (FIG. 12) with an IC50=~2.5 nM (FIG. 13). To develop nuclease-resistant siNA for in vivo applications, siNAs can be modified to contain stabilizing chemical modifications. Such modifications include phosphorothioate linkages (P=S), 2'-O-methyl nucleotides, 2'-fluoro (F) nucleotides, 2'-deoxy nucleotides, universal base nucleotides, 5' and/or 3' end modifications and a variety of other nucleotide and non-nucleotide modifications, such as those described herein, in one or both siNA strands. Using this systematic approach, active siNA molecules have been identified that are substantially more resistant to nucleases. Several of these constructs were tested in the HCV/poliovirus chimera system, demonstrating significant reduction in viral replication (see FIGS. 14-17). siNA constructs shown in FIGS. 14-17 are referred to by RPI#s that are cross referenced to Table III. siNA activity is compared to relevant controls (untreated cells, scrambled/inactive control sequences, or transfection controls). FIG. 14 shows the inhibition of HCV RNA in the HCV/poliovirus chimera system using chemically modified siNA construct 30051/30053, which construct has inverted deoxy abasic nucleotides at the 3' and 5' ends, several phosphorothioate linkages, and 5-nitroindole nucleotides. FIG. 15 shows the inhibition of HCV RNA in the HCV/poliovirus chimera system using chemically modified siNA construct 30055/30057, which construct has inverted deoxy abasic nucleotides at the 3' and 5' ends, several phosphorothioate linkages, and 5-nitroindole nucleotides. FIGS. 16 and 17 show the inhibition of HCV RNA in the HCV/poliovirus chimera system using unmodified siNA construct (29586/29579) and chemically modified siNA constructs 30417/30419, 30417/30420, 30418/30419, and combinations thereof at 10 nM and 25 nM siNA, respectively. As shown in FIGS. 14-17, siNA constructs of the invention provide potent inhibition of HCV RNA in the HCV/poliovirus chimera system. As such, siNA constructs, including chemically modified, nuclease resistant siNA molecules, represent an important class of therapeutic agents for treating chronic HCV infection.

Example 11 siNA Inhibition of an HCV RNA Expression in an HCV Replicon System

An HCV replicon system was used to test the efficacy of siNAs targeting HCV RNA. The reagents are tested in cell culture using Huh7 cells (see for example Randall et al., 2003, PNAS USA, 100, 235-240) to determine the extent of RNA and protein inhibition. siNA were selected against the HCV target as described herein. RNA inhibition was measured after delivery of these reagents by a suitable transfection agent to Huh7 cells. Relative amounts of target RNA are measured versus actin using real-time PCR monitoring of amplification (e.g., ABI 7700 Taqman®). A comparison is made to a mixture of oligonucleotide sequences designed to target unrelated targets or to a randomized siNA control with the same overall length and chemistry, but with randomly substituted nucleotides at each position. Primary and secondary lead reagents were chosen for the target and optimization performed. After an optimal transfection agent concentration is chosen, a RNA time-course of inhibition is performed with the lead siNA molecule. In addition, a cell-plating format can be used to determine RNA inhibition. A non-limiting example of a multiple target screen to assay siNA mediated inhibition of HCV RNA is shown in FIG. 18. siNA reagents (Table I) were transfected at 25 nM into Huh7 cells and HCV RNA quantitated compared to untreated cells ("cells" column in the figure) and cells transfected with lipofectamine ("LFA2K" column in the figure). As shown in the Figure, several siNA constructs show significant inhibition of HCV RNA expression in the Huh7 replicon system. Chemically modified siNA constructs were then screened as described above, with a non-limiting example of a Stab 7/8 (see Table IV) chemistry siNA construct screen shown in FIG. 20. A follow up dose response study using chemically modified siNA constructs (Stab 4/5, see Table IV) at concentrations of 5 nM, 10 nM, 25 nM and 100 nM compared to matched chemistry inverted controls is shown in FIG. 19, whereas a dose response study for Stab 7/8 constructs at concentrations of 5 nM, 10 nM, 25 nM, 50 nM and 100 nM compared to matched chemistry inverted controls is shown in FIG. 21.

Example 12

Effect of Interferon/siNA Combination Treatment on Replication of HCV Subgenomic Replicon in Huh7 Cells To investigate combination use of RNAi and interferon in the inhibition of HCV replication, siNA and interferon combination treatments were assayed in the HCV Subgenomic Replicon in Huh7 cells. Huh7 cells containing the HCV subgenomic replicon Clone A were plated in 96-well plates at a density of 9,600 cells per well and incubated overnight at 37° C. The cells were then treated with interferon alone, siNAs or inverted sequence controls alone, or with interferon in combination with siNAs or inverted controls. A sub-optimal dose of interferon was used in order to observe possible potentiation of the interferon anti-viral activity in the presence of the HCV-targeted siNA. The cells were transfected with HCV targeted siNAs (31703/31707) or inverted sequence controls (31711/31715) at 5, 10, 25, 50, or 100 nM using 0.35 ul/well of Lipofectamine 2000 in media alone, or media to which was added 1.7 Units/ml of Infergen (Amgen). The cells were then incubated at 37° C. for 48 or 72 hours, at which time total RNA was isolated using an Invitek 96-well RNA isolation kit. To quantitate the levels of RNA from the HCV replicon, real-time RT-PCR was performed using probes and primers to the neomycin resistance region of the replicon. Results are shown in FIG. 22. Levels of the replicon RNA were normalized to the levels of cellular GAPDH mRNA. These data demonstrate potentiation of the effect of combination siNA/interferon treatment compared to interferon alone.

Example 13

Indications

The present body of knowledge in HCV research indicates the need for methods to assay HCV activity and for compounds that can regulate HCV expression for research, diagnostic, and therapeutic use. As described herein, the nucleic acid molecules of the present invention can be used in assays to diagnose disease state related of HCV levels. In addition, the nucleic acid molecules can be used to treat disease state related to HCV levels.

Particular degenerative and disease states that can be associated with HCV expression modulation include, but are not limited to, HCV infection, liver failure, hepatocellular carcinoma, cirrhosis, and/or other disease states associated with HCV infection.

Example 14

Interferons

Interferons represent a non-limiting example of a class of compounds that can be used in conjunction with the siNA molecules of the invention for treating the diseases and/or conditions described herein. Type I interferons (IFN) are a class of natural cytokines that includes a family of greater than 25 IFN-α subtypes (Pesta, 1986, *Methods Enzymol.* 119, 3-14) as well as IFN-β, and IFN-ω. Although evolutionarily derived from the same gene (Diaz et al., 1994, *Genomics* 22, 540-552), there are many differences in the primary sequence of these molecules, implying an evolutionary divergence in biologic activity. All type I IFN share a common pattern of biologic effects that begin with binding of the IFN to the cell surface receptor (Pfeffer & Strulovici, 1992, Transmembrane secondary messengers for IFN-α/β. In: *Interferon. Principles and Medical Applications.*, S. Baron, D. H. Coopenhaver, F. Dianzani, W. R. Fleischmann Jr., T. K. Hughes Jr., G. R. Kimpel, D. W. Niesel, G. J. Stanton, and S. K. Tyring, eds. 151-160). Binding is followed by activation of tyrosine kinases, including the Janus tyrosine kinases and the STAT proteins, which leads to the production of several IFN-stimulated gene products (Johnson et al., 1994, *Sci. Am.* 270, 68-75). The IFN-stimulated gene products are responsible for the pleotropic biologic effects of type I IFN, including antiviral, antiproliferative, and immunomodulatory effects, cytokine induction, and HLA class I and class II regulation (Pestka et al., 1987, *Annu. Rev. Biochem* 56, 727). Examples of IFN-stimulated gene products include 2-5-oligoadenylate synthetase (2-5 OAS), $β_2$-microglobulin, neopterin, p68 kinases, and the Mx protein (Chebath & Revel, 1992, The 2-5 A system: 2-5 A synthetase, isospecies and functions. In: *Interferon. Principles and Medical Applications*, S. Baron, D. H. Coopenhaver, F. Dianzani, W. R. Jr. Fleischmann, T. K. Jr Hughes, G. R. Kimpel, D. W. Niesel, G. J. Stanton, and S. K. Tyring, eds., pp. 225-236; Samuel, 1992, The RNA-dependent P1/eIF-2α protein kinase. In: *Interferon. Principles and Medical Applications.* S. Baron, D. H. Coopenhaver, F. Dianzani, W. R. Fleischmann Jr., T. K. Hughes Jr., G. R. Kimpel, D. W. Niesel, G. H. Stanton, and S. K. Tyring, eds. 237-250; Horisberger, 1992, MX protein: function and Mechanism of Action. In: *Interferon. Principles and Medical Applications.* S. Baron, D. H. Coopenhaver, F. Dianzani, W. R. Fleischmann Jr., T. K. Hughes Jr., G. R. Kimpel, D. W. Niesel, G. H. Stanton, and S. K. Tyring, eds. 215-224). Although all type I IFN have similar biologic effects, not all the activities are shared by each type I IFN, and in many cases, the extent of activity varies quite substantially for each IFN subtype (Fish et al, 1989, *J. Interferon Res.* 9, 97-114; Ozes et al., 1992, *J. Interferon Res.* 12, 55-59). More specifically, investigations into the properties of different subtypes of IFN-α and molecular hybrids of IFN-α have shown differences in pharmacologic properties (Rubinstein, 1987, *J. Interferon Res.* 7, 545-551). These pharmacologic differences can arise from as few as three amino acid residue changes (Lee et al., 1982, *Cancer Res.* 42, 1312-1316).

Eighty-five to 166 amino acids are conserved in the known IFN-α subtypes. Excluding the IFN-α pseudogenes, there are approximately 25 known distinct IFN-α subtypes. Pairwise comparisons of these nonallelic subtypes show primary sequence differences ranging from 2% to 23%. In addition to the naturally occurring IFNs, a non-natural recombinant type I interferon known as consensus interferon (CIFN) has been synthesized as a therapeutic compound (Tong et al., 1997, *Hepatology* 26, 747-754).

Interferon is currently in use for at least 12 different indications, including infectious and autoimmune diseases and cancer (Borden, 1992, *N. Engl. J. Med.* 326, 1491-1492). For autoimmune diseases, IFN has been utilized for treatment of rheumatoid arthritis, multiple sclerosis, and Crohn's disease. For treatment of cancer, IFN has been used alone or in combination with a number of different compounds. Specific types of cancers for which IFN has been used include squamous cell carcinomas, melanomas, hypernephromas, hemangiomas, hairy cell leukemia, and Kaposi's sarcoma. In the treatment of infectious diseases, IFNs increase the phagocytic activity of macrophages and cytotoxicity of lymphocytes and inhibits the propagation of cellular pathogens. Specific indications for which IFN has been used as treatment include hepatitis B, human papillomavirus types 6 and 11 (i.e. genital warts) (Leventhal et al., 1991, *N Engl J Med* 325, 613-617), chronic granulomatous disease, and hepatitis C virus.

Numerous well controlled clinical trials using IFN-alpha in the treatment of chronic HCV infection have demonstrated that treatment three times a week results in lowering of serum ALT values in approximately 50% (range 40% to 70%) of patients by the end of 6 months of therapy (Davis et al., 1989, N. Engl. J. Med. 321, 1501-1506; Marcellin et al., 1991, *Hepatology* 13, 393-397; Tong et al., 1997, Hepatology 26, 747-754; Tong et al., *Hepatology* 26, 1640-1645). However, following cessation of interferon treatment, approximately 50% of the responding patients relapsed, resulting in a "durable" response rate as assessed by normalization of serum ALT concentrations of approximately 20 to 25%. In addition, studies that have examined six months of type 1 interferon therapy using changes in HCV RNA values as a clinical endpoint have demonstrated that up to 35% of patients will have a loss of HCV RNA by the end of therapy (Tong et al., 1997, supra). However, as with the ALT endpoint, about 50% of the patients relapse six months following cessation of therapy resulting in a durable virologic response of only 12% (23). Studies that have examined 48 weeks of therapy have demonstrated that the sustained virological response is up to 25%.

Pegylated interferons, i.e., interferons conjugated with polyethylene glycol (PEG), have demonstrated improved characteristics over interferon. Advantages incurred by PEG conjugation can include an improved pharmacokinetic profile compared to interferons lacking PEG, thus imparting more convenient dosing regimes, improved tolerance, and improved antiviral efficacy. Such improvements have been demonstrated in clinical studies of both polyethylene glycol interferon alfa-2a (PEGASYS, Roche) and polyethylene glycol interferon alfa-2b (VIRAFERON PEG, PEG-INTRON, Enzon/Schering Plough).

siNA molecules in combination with interferons and polyethylene glycol interferons have the potential to improve the effectiveness of treatment of HCV or any of the other indications discussed above. siNA molecules targeting RNAs associated with HCV infection can be used individually or in combination with other therapies such as interferons and polyethylene glycol interferons and to achieve enhanced efficacy.

Example 15

Diagnostic Uses

The siNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of siNA molecules involves utilizing reconstituted RNAi systems, for example, using cellular lysates or partially purified cellular lysates. siNA molecules of this invention can be used as diagnostic tools to examine genetic drift and mutations within diseased cells or to detect the presence of endogenous or exogenous, for example viral, RNA in a cell. The close relationship between siNA activity and the structure of the target RNA allows the detection of mutations in any region of the molecule, which alters the base-pairing and three-dimensional structure of the target RNA. By using multiple siNA molecules described in this invention, one can map nucleotide changes, which are important to RNA structure and function in vitro, as well as in cells and tissues. Cleavage of target RNAs with siNA molecules can be used to inhibit gene expression and define the role of specified gene products in the progression of disease or infection. In this manner, other genetic targets can be defined as important mediators of the disease. These experiments will lead to better treatment of the disease progression by affording the possibility of combination therapies (e.g., multiple siNA molecules targeted to different genes, siNA molecules coupled with known small molecule inhibitors, or intermittent treatment with combinations siNA molecules and/or other chemical or biological molecules). Other in vitro uses of siNA molecules of this invention are well known in the art, and include detection of the presence of mRNAs associated with a disease, infection, or related condition. Such RNA is detected by determining the presence of a cleavage product after treatment with an siNA using standard methodologies, for example, fluorescence resonance emission transfer (FRET).

In a specific example, siNA molecules that cleave only wild-type or mutant forms of the target RNA are used for the assay. The first siNA molecules (i.e., those that cleave only wild-type forms of target RNA) are used to identify wild-type RNA present in the sample and the second siNA molecules (i.e., those that cleave only mutant forms of target RNA) are used to identify mutant RNA in the sample. As reaction controls, synthetic substrates of both wild-type and mutant RNA are cleaved by both siNA molecules to demonstrate the relative siNA efficiencies in the reactions and the absence of cleavage of the "non-targeted" RNA species. The cleavage products from the synthetic substrates also serve to generate size markers for the analysis of wild-type and mutant RNAs in the sample population. Thus, each analysis requires two siNA molecules, two substrates and one unknown sample, which is combined into six reactions. The presence of cleavage products is determined using an RNase protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., disease related or infection related) is adequate to establish risk. If probes of comparable specific activity are used for both transcripts, then a qualitative comparison of RNA levels is adequate and decreases the cost of the initial diagnosis. Higher mutant form to wild-type ratios are correlated with higher risk whether RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying siNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

TABLE I

HCV Accession Numbers

| Seq Name | Acc# | LOCUS |
|---|---|---|
| gi\|329763\|gb\|M84754.1\|HPCGENANTI | M84754.1 | HPCGENANTI |
| gi\|567059\|gb\|U16362.1\|HCU16362 | U16362.1 | HCU16362 |
| gi\|5918956\|gb\|AF165059.1\|AF165059 | AF165059.1 | AF165059 |
| gi\|385583\|gb\|S62220.1\|S62220 | S62220.1 | S62220 |
| gi\|6010587\|gb\|AF177040.1\|AF177040 | AF177040.1 | AF177040 |
| gi\|5748510\|emb\|AJ238800.1\|HCJ238800 | AJ238800.1 | HCJ238800 |

TABLE I-continued

HCV Accession Numbers

| Seq Name | Acc# | LOCUS |
|---|---|---|
| gi\|7650221\|gb\|AF207752.1\|AF207752 | AF207752.1 | AF207752 |
| gi\|11559454\|dbj\|AB049094.1\|AB049094 | AB049094.1 | AB049094 |
| gi\|3550760\|dbj\|D84263.1\|D84263 | D84263.1 | D84263 |
| gi\|221610\|dbj\|D90208.1\|HPCJCG | D90208.1 | HPCJCG |
| gi\|558520\|dbj\|D28917.1\|HPCK3A | D28917.1 | HPCK3A |
| gi\|2176577\|dbj\|E08461.1\|E08461 | E08461.1 | E08461 |
| gi\|6707285\|gb\|AF169005.1\|AF169005 | AF169005.1 | AF169005 |
| gi\|12309923\|emb\|AX057094.1\|AX057094 | AX057094.1 | AX057094 |
| gi\|6010585\|gb\|AF177039.1\|AF177039 | AF177039.1 | AF177039 |
| gi\|7329202\|gb\|AF238482.1\|AF238482 | AF238482.1 | AF238482 |
| gi\|11559464\|dbj\|AB049099.1\|AB049099 | AB049099.1 | AB049099 |
| gi\|5918932\|gb\|AF165047.1\|AF165047 | AF165047.1 | AF165047 |
| gi\|5918946\|gb\|AF165054.1\|AF165054 | AF165054.1 | AF165054 |
| gi\|7650233\|gb\|AF207758.1\|AF207758 | AF207758.1 | AF207758 |
| gi\|19568932\|gb\|AF483269.1\| | AF483269.1 | |
| gi\|7650247\|gb\|AF207765.1\|AF207765 | AF207765.1 | AF207765 |
| gi\|12309919\|emb\|AX057086.1\|AX057086 | AX057086.1 | AX057086 |
| gi\|5708597\|dbj\|E10839.1\|E10839 | E10839.1 | E10839 |
| gi\|2327074\|gb\|AF011753.1\|AF011753 | AF011753.1 | AF011753 |
| gi\|12310062\|emb\|AX057317.1\|AX057317 | AX057317.1 | AX057317 |
| gi\|221606\|dbj\|D10750.1\|HPCJ491 | D10750.1 | HPCJ491 |
| gi\|2174448\|dbj\|E06261.1\|E06261 | E06261.1 | E06261 |
| gi\|3098640\|gb\|AF054251.1\|AF054251 | AF054251.1 | AF054251 |
| gi\|18027684\|gb\|AF313916.1\|AF313916 | AF313916.1 | AF313916 |
| gi\|329873\|gb\|M62321.1\|HPCPLYPRE | M62321.1 | HPCPLYPRE |
| gi\|464177\|dbj\|D14853.1\|HPCCGS | D14853.1 | HPCCGS |
| gi\|15422182\|gb\|AY051292.1\| | AY051292.1 | |
| gi\|676877\|dbj\|D49374.1\|HPCFG | D49374.1 | HPCFG |
| gi\|1030706\|dbj\|D50480.1\|HPCK1R1 | D50480.1 | HPCK1R1 |
| gi\|7650223\|gb\|AF207753.1\|AF207753 | AF207753.1 | AF207753 |
| gi\|7650237\|gb\|AF207760.1\|AF207760 | AF207760.1 | AF207760 |
| gi\|11559444\|dbj\|AB049089.1\|AB049089 | AB049089.1 | AB049089 |
| gi\|3550762\|dbj\|D84264.1\|D84264 | D84264.1 | D84264 |
| gi\|12831192\|gb\|AF333324.1\|AF333324 | AF333324.1 | AF333324 |
| gi\|13122265\|dbj\|AB047641.1\|AB047641 | AB047641.1 | AB047641 |
| gi\|7329204\|gb\|AF238483.1\|AF238483 | AF238483.1 | AF238483 |
| gi\|11559468\|dbj\|AB049101.1\|AB049101 | AB049101.1 | AB049101 |
| gi\|5918934\|gb\|AF165048.1\|AF165048 | AF165048.1 | AF165048 |
| gi\|5918948\|gb\|AF165055.1\|AF165055 | AF165055.1 | AF165055 |
| gi\|7650235\|gb\|AF207759.1\|AF207759 | AF207759.1 | AF207759 |
| gi\|7650249\|gb\|AF207766.1\|AF207766 | AF207766.1 | AF207766 |
| gi\|9843676\|emb\|AJ278830.1\|HEC278830 | AJ278830.1 | HEC278830 |
| gi\|11559450\|dbj\|AB049092.1\|AB049092 | AB049092.1 | AB049092 |
| gi\|2943783\|dbj\|D89815.1\|D89815 | D89815.1 | D89815 |
| gi\|9626438\|ref\|NC_001433.1\| | NC_001433.1 | |
| gi\|12310134\|emb\|AX057395.1\|AX057395 | AX057395.1 | AX057395 |
| gi\|11559460\|dbj\|AB049097.1\|AB049097 | AB049097.1 | AB049097 |
| gi\|12309922\|emb\|AX057092.1\|AX057092 | AX057092.1 | AX057092 |
| gi\|2174644\|dbj\|E06457.1\|E06457 | E06457.1 | E06457 |
| gi\|2176559\|dbj\|E08443.1\|E08443 | E08443.1 | E08443 |
| gi\|5918960\|gb\|AF165061.1\|AF165061 | AF165061.1 | AF165061 |
| gi\|2326454\|emb\|Y12083.1\|HCV12083 | Y12083.1 | HCV12083 |
| gi\|5918938\|gb\|AF165050.1\|AF165050 | AF165050.1 | AF165050 |
| gi\|7650225\|gb\|AF207754.1\|AF207754 | AF207754.1 | AF207754 |
| gi\|7650261\|gb\|AF207772.1\|AF207772 | AF207772.1 | AF207772 |
| gi\|1030704\|dbj\|D50485.1\|HPCK1S2 | D50485.1 | HPCK1S2 |
| gi\|3550758\|dbj\|D84262.1\|D84262 | D84262.1 | D84262 |
| gi\|7650239\|gb\|AF207761.1\|AF207761 | AF207761.1 | AF207761 |
| gi\|3550764\|dbj\|D84265.1\|D84265 | D84265.1 | D84265 |
| gi\|7329206\|gb\|AF238484.1\|AF238484 | AF238484.1 | AF238484 |
| gi\|2176516\|dbj\|E08399.1\|E08399 | E08399.1 | E08399 |
| gi\|5918936\|gb\|AF165049.1\|AF165049 | AF165049.1 | AF165049 |
| gi\|11559446\|dbj\|AB049090.1\|AB049090 | AB049090.1 | AB049090 |
| gi\|5441837\|emb\|AJ242653.1\|SSE242653 | AJ242653.1 | SSE242653 |
| gi\|3098641\|gb\|AF054252.1\|AF054252 | AF054252.1 | AF054252 |
| gi\|4753720\|emb\|AJ132997.1\|HCV132997 | AJ132997.1 | HCV132997 |
| gi\|5420376\|emb\|AJ238799.1\|HCJ238799 | AJ238799.1 | HCJ238799 |
| gi\|11559440\|dbj\|AB049087.1\|AB049087 | AB049087.1 | AB049087 |
| gi\|15529110\|gb\|AY045702.1\| | AY045702.1 | |
| gi\|560788\|dbj\|D30613.1\|HPCPP | D30613.1 | HPCPP |
| gi\|11225869\|emb\|AX036253.1\|AX036253 | AX036253.1 | AX036253 |
| gi\|11559456\|dbj\|AB049095.1\|AB049095 | AB049095.1 | AB049095 |
| gi\|329770\|gb\|M58335.1\|HPCHUMR | M58335.1 | HPCHUMR |
| gi\|6707279\|gb\|AF169002.1\|AF169002 | AF169002.1 | AF169002 |
| gi\|221586\|dbj\|D10749.1\|HPCHCJ1 | D10749.1 | HPCHCJ1 |
| gi\|2171981\|dbj\|E03766.1\|E03766 | E03766.1 | E03766 |
| gi\|6010579\|gb\|AF177036.1\|AF177036 | AF177036.1 | AF177036 |
| gi\|1030703\|dbj\|D50484.1\|HPCK1S3 | D50484.1 | HPCK1S3 |
| gi\|3098650\|gb\|AF054257.1\|AF054257 | AF054257.1 | AF054257 |
| gi\|5821154\|dbj\|AB016785.1\|AB016785 | AB016785.1 | AB016785 |
| gi\|5918962\|gb\|AF165062.1\|AF165062 | AF165062.1 | AF165062 |
| gi\|7650227\|gb\|AF207755.1\|AF207755 | AF207755.1 | AF207755 |
| gi\|7650263\|gb\|AF207773.1\|AF207773 | AF207773.1 | AF207773 |
| gi\|1183030\|dbj\|D63822.1\|HPCJK046E2 | D63822.1 | HPCJK046E2 |
| gi\|13122271\|dbj\|AB047644.1\|AB047644 | AB047644.1 | AB047644 |
| gi\|2443428\|gb\|U89019.1\|HCU89019 | U89019.1 | HCU89019 |
| gi\|2462303\|emb\|Y13184.1\|HCV1480 | Y13184.1 | HCV1480 |
| gi\|7329208\|gb\|AF238485.1\|AF238485 | AF238485.1 | AF238485 |
| gi\|1160327\|dbj\|D14484.1\|HPCJRNA | D14484.1 | HPCJRNA |
| gi\|12309921\|emb\|AX057090.1\|AX057090 | AX057090.1 | AX057090 |
| gi\|3098643\|gb\|AF054253.1\|AF054253 | AF054253.1 | AF054253 |
| gi\|21397075\|gb\|AF511948.1\| | AF511948.1 | |
| gi\|1030701\|dbj\|D50482.1\|HPCK1R3 | D50482.1 | HPCK1R3 |
| gi\|1030702\|dbj\|D50483.1\|HPCK1S1 | D50483.1 | HPCK1S1 |
| gi\|3098632\|gb\|AF054247.1\|AF054247 | AF054247.1 | AF054247 |
| gi\|59478\|emb\|X61596.1\|HCVJK1G | X61596.1 | HCVJK1G |
| gi\|3098652\|gb\|AF054258.1\|AF054258 | AF054258.1 | AF054258 |
| gi\|5918950\|gb\|AF165056.1\|AF165056 | AF165056.1 | AF165056 |
| gi\|7650251\|gb\|AF207767.1\|AF207767 | AF207767.1 | AF207767 |
| gi\|5918964\|gb\|AF165063.1\|AF165063 | AF165063.1 | AF165063 |
| gi\|5918928\|gb\|AF165045.1\|AF165045 | AF165045.1 | AF165045 |
| gi\|5532421\|gb\|AF139594.1\|AF139594 | AF139594.1 | AF139594 |
| gi\|13122267\|dbj\|AB047642.1\|AB047642 | AB047642.1 | AB047642 |
| gi\|5441831\|emb\|AJ242651.1\|SSE242651 | AJ242651.1 | SSE242651 |
| gi\|7650265\|gb\|AF207774.1\|AF207774 | AF207774.1 | AF207774 |
| gi\|7650229\|gb\|AF207756.1\|AF207756 | AF207756.1 | AF207756 |
| gi\|1183032\|dbj\|D63821.1\|HPCJK049E1 | D63821.1 | HPCJK049E1 |
| gi\|2175714\|dbj\|E07579.1\|E07579 | E07579.1 | E07579 |
| gi\|1212741\|dbj\|D45172.1\|HPCHCPO | D45172.1 | HPCHCPO |
| gi\|5708511\|dbj\|E05027.1\|E05027 | E05027.1 | E05027 |
| gi\|1483141\|dbj\|D50409.1\|D50409 | D50409.1 | D50409 |
| gi\|13122261\|dbj\|AB047639.1\|AB047639 | AB047639.1 | AB047639 |
| gi\|6521008\|dbj\|AB031663.1\|AB031663 | AB031663.1 | AB031663 |
| gi\|633201\|emb\|X76918.1\|HCVCENS1 | X76918.1 | HCVCENS1 |
| gi\|329737\|gb\|M67463.1\|HPCCGAA | M67463.1 | HPCCGAA |
| gi\|11559452\|dbj\|AB049093.1\|AB049093 | AB049093.1 | AB049093 |
| gi\|13619567\|emb\|AX100563.1\|AX100563 | AX100563.1 | AX100563 |
| gi\|221604\|dbj\|D13558.1\|HPCJ483 | D13558.1 | HPCJ483 |
| gi\|11225872\|emb\|AX036256.1\|AX036256 | AX036256.1 | AX036256 |
| gi\|1749761\|dbj\|D89872.1\|D89872 | D89872.1 | D89872 |
| gi\|5918940\|gb\|AF165051.1\|AF165051 | AF165051.1 | AF165051 |
| gi\|4753718\|emb\|AJ132996.1\|HCV132996 | AJ132996.1 | HCV132996 |

TABLE I-continued

HCV Accession Numbers

| Seq Name | Acc# | LOCUS |
|---|---|---|
| gi\|7650241\|gb\|AF207762.1\|AF207762 | AF207762.1 | AF207762 |
| gi\|3098645\|gb\|AF054254.1\|AF054254 | AF054254.1 | AF054254 |
| gi\|9930556\|gb\|AF290978.1\|AF290978 | AF290978.1 | AF290978 |
| gi\|11559462\|dbj\|AB049098.1\|AB049098 | AB049098.1 | AB049098 |
| gi\|2764397\|emb\|AJ000009.1\|HCVPOLYP | AJ000009.1 | HCVPOLYP |
| gi\|221608\|dbj\|D10988.1\|HPCJ8G | D10988.1 | HPCJ8G |
| gi\|3098634\|gb\|AF054248.1\|AF054248 | AF054248.1 | AF054248 |
| gi\|221650\|dbj\|D00944.1\|HPCPOLP | D00944.1 | HPCPOLP |
| gi\|306286\|gb\|M96362.1\|HPCUNKCDS | M96362.1 | HPCUNKCDS |
| gi\|3098654\|gb\|AF054259.1\|AF054259 | AF054259.1 | AF054259 |
| gi\|5918952\|gb\|AF165057.1\|AF165057 | AF165057.1 | AF165057 |
| gi\|7650253\|gb\|AF207768.1\|AF207768 | AF207768.1 | AF207768 |
| gi\|5918966\|gb\|AF165064.1\|AF165064 | AF165064.1 | AF165064 |
| gi\|15487693\|gb\|AF356827.1\|AF356827 | AF356827.1 | AF356827 |
| gi\|5738246\|gb\|AF176573.1\|AF176573 | AF176573.1 | AF176573 |
| gi\|11559448\|dbj\|AB049091.1\|AB049091 | AB049091.1 | AB049091 |
| gi\|21397077\|gb\|AF511950.1\| | AF511950.1 | |
| gi\|3098638\|gb\|AF054250.1\|AF054250 | AF054250.1 | AF054250 |
| gi\|6707281\|gb\|AF169003.1\|AF169003 | AF169003.1 | AF169003 |
| gi\|329739\|gb\|L02836.1\|HPCCGENOM | L02836.1 | HPCCGENOM |
| gi\|6010581\|gb\|AF177037.1\|AF177037 | AF177037.1 | AF177037 |
| gi\|11559442\|dbj\|AB049088.1\|AB049088 | AB049088.1 | AB049088 |
| gi\|21397076\|gb\|AF511949.1\| | AF511949.1 | |
| gi\|1030705\|dbj\|D50481.1\|HPCK1R2 | D50481.1 | HPCK1R2 |
| gi\|2176384\|dbj\|E08264.1\|E08264 | E08264.1 | E08264 |
| gi\|3660725\|gb\|AF064490.1\|AF064490 | AF064490.1 | AF064490 |
| gi\|2252489\|emb\|Y11604.1\|HCV4APOLY | Y11604.1 | HCV4APOLY |
| gi\|5918942\|gb\|AF165052.1\|AF165052 | AF165052.1 | AF165052 |
| gi\|2895898\|gb\|AF046866.1\|AF046866 | AF046866.1 | AF046866 |
| gi\|7650243\|gb\|AF207763.1\|AF207763 | AF207763.1 | AF207763 |
| gi\|11559458\|dbj\|AB049096.1\|AB049096 | AB049096.1 | AB049096 |
| gi\|13122263\|dbj\|AB047640.1\|AB047640 | AB047640.1 | AB047640 |
| gi\|5708574\|dbj\|E08263.1\|E08263 | E08263.1 | E08263 |
| gi\|7650257\|gb\|AF207770.1\|AF207770 | AF207770.1 | AF207770 |
| gi\|3098647\|gb\|AF054255.1\|AF054255 | AF054255.1 | AF054255 |
| gi\|11559466\|dbj\|AB049100.1\|AB049100 | AB049100.1 | AB049100 |
| gi\|1181831\|gb\|U45476.1\|HCU45476 | U45476.1 | HCU45476 |
| gi\|2327070\|gb\|AF011751.1\|AF011751 | AF011751.1 | AF011751 |
| gi\|3098636\|gb\|AF054249.1\|AF054249 | AF054249.1 | AF054249 |
| gi\|7329210\|gb\|AF238486.1\|AF238486 | AF238486.1 | AF238486 |
| gi\|221612\|dbj\|D11168.1\|HPCJTA | D11168.1 | HPCJTA |
| gi\|960359\|dbj\|D63857.1\|HPVHCVN | D63857.1 | HPVHCVN |
| gi\|13122273\|dbj\|AB047645.1\|AB047645 | AB047645.1 | AB047645 |
| gi\|5918954\|gb\|AF165058.1\|AF165058 | AF165058.1 | AF165058 |
| gi\|7650255\|gb\|AF207769.1\|AF207769 | AF207769.1 | AF207769 |
| gi\|437107\|gb\|U01214.1\|HCU01214 | U01214.1 | HCU01214 |
| gi\|471116\|dbj\|D10934.1\|HPCRNA | D10934.1 | HPCRNA |
| gi\|13026028\|dbj\|E66593.1\|E66593 | E66593.1 | E66593 |
| gi\|2316097\|gb\|AF009606.1\|AF009606 | AF009606.1 | AF009606 |
| gi\|6707283\|gb\|AF169004.1\|AF169004 | AF169004.1 | AF169004 |
| gi\|514395\|dbj\|D17763.1\|HPCEGS | D17763.1 | HPCEGS |
| gi\|9757541\|dbj\|AB030907.1\|AB030907 | AB030907.1 | AB030907 |
| gi\|7329200\|gb\|AF238481.1\|AF238481 | AF238481.1 | AF238481 |
| gi\|6010583\|gb\|AF177038.1\|AF177038 | AF177038.1 | AF177038 |
| gi\|2172621\|dbj\|E04420.1\|E04420 | E04420.1 | E04420 |
| gi\|8926244\|gb\|AF271632.1\|AF271632 | AF271632.1 | AF271632 |
| gi\|5918930\|gb\|AF165046.1\|AF165046 | AF165046.1 | AF165046 |
| gi\|7650231\|gb\|AF207757.1\|AF207757 | AF207757.1 | AF207757 |
| gi\|5918944\|gb\|AF165053.1\|AF165053 | AF165053.1 | AF165053 |
| gi\|7650245\|gb\|AF207764.1\|AF207764 | AF207764.1 | AF207764 |
| gi\|12309920\|emb\|AX057088.1\|AX057088 | AX057088.1 | AX057088 |
| gi\|5918958\|gb\|AF165060.1\|AF165060 | AF165060.1 | AF165060 |
| gi\|7650259\|gb\|AF207771.1\|AF207771 | AF207771.1 | AF207771 |
| gi\|7341102\|gb\|AF208024.1\|AF208024 | AF208024.1 | AF208024 |
| gi\|3098649\|gb\|AF054256.1\|AF054256 | AF054256.1 | AF054256 |
| gi\|1944375\|dbj\|D85516.1\|D85516 | D85516.1 | D85516 |
| gi\|2327072\|gb\|AF011752.1\|AF011752 | AF011752.1 | AF011752 |
| gi\|221614\|dbj\|D11355.1\|HPCJTB | D11355.1 | HPCJTB |
| gi\|13122269\|dbj\|AB047643.1\|AB047643 | AB047643.1 | AB047643 |

TABLE II

HCV siNA and Target Sequences
GenBank Accession No. D11168 (HCV)

| Sequence | SeqID | Upper seq | Seq ID | Lower seq | Seq ID |
|---|---|---|---|---|---|
| GCCCCGGGAGGUCUCGUAG | 1 | GCCCCGGGAGGUCUCGUAG | 1 | CUACGAGACCUCCCGGGGC | 697 |
| UGUGGUACUGCCUGAUAGG | 2 | UGUGGUACUGCCUGAUAGG | 2 | CCUAUCAGGCAGUACCACA | 698 |
| UUGUGGUACUGCCUGAUAG | 3 | UUGUGGUACUGCCUGAUAG | 3 | CUAUCAGGCAGUACCACAA | 699 |
| CCCCGGGAGGUCUCGUAGA | 4 | CCCCGGGAGGUCUCGUAGA | 4 | UCUACGAGACCUCCCGGGG | 700 |
| GUGGUACUGCCUGAUAGGG | 5 | GUGGUACUGCCUGAUAGGG | 5 | CCCUAUCAGGCAGUACCAC | 701 |
| CUGCCUGAUAGGGUGCUUG | 6 | CUGCCUGAUAGGGUGCUUG | 6 | CAAGCACCCUAUCAGGCAG | 702 |
| CCUUGUGGUACUGCCUGAU | 7 | CCUUGUGGUACUGCCUGAU | 7 | AUCAGGCAGUACCACAAGG | 703 |
| GCGAAAGGCCUUGUGGUAC | 8 | GCGAAAGGCCUUGUGGUAC | 8 | GUACCACAAGGCCUUUCGC | 704 |
| UACUGCCUGAUAGGGUGCU | 9 | UACUGCCUGAUAGGGUGCU | 9 | AGCACCCUAUCAGGCAGUA | 705 |
| GGUACUGCCUGAUAGGGUG | 10 | GGUACUGCCUGAUAGGGUG | 10 | CACCCUAUCAGGCAGUACC | 706 |
| AAAGGCCUUGUGGUACUGC | 11 | AAAGGCCUUGUGGUACUGC | 11 | GCAGUACCACAAGGCCUUU | 707 |
| AAGGCCUUGUGGUACUGCC | 12 | AAGGCCUUGUGGUACUGCC | 12 | GGCAGUACCACAAGGCCUU | 708 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| CUUGUGGUACUGCCUGAUA | 13 | CUUGUGGUACUGCCUGAUA | 13 | UAUCAGGCAGUACCACAAG | 709 |
| AGGCCUUGUGGUACUGCCU | 14 | AGGCCUUGUGGUACUGCCU | 14 | AGGCAGUACCACAAGGCCU | 710 |
| GUACUGCCUGAUAGGGUGC | 15 | GUACUGCCUGAUAGGGUGC | 15 | GCACCCUAUCAGGCAGUAC | 711 |
| ACUGCCUGAUAGGGUGCUU | 16 | ACUGCCUGAUAGGGUGCUU | 16 | AAGCACCCUAUCAGGCAGU | 712 |
| CUUGCGAGUGCCCCGGGAG | 17 | CUUGCGAGUGCCCCGGGAG | 17 | CUCCCGGGGCACUCGCAAG | 713 |
| CUGAUAGGGUGCUUGCGAG | 18 | CUGAUAGGGUGCUUGCGAG | 18 | CUCGCAAGCACCCUAUCAG | 714 |
| UUGCGAGUGCCCCGGGAGG | 19 | UUGCGAGUGCCCCGGGAGG | 19 | CCUCCCGGGGCACUCGCAA | 715 |
| CCUGAUAGGGUGCUUGCGA | 20 | CCUGAUAGGGUGCUUGCGA | 20 | UCGCAAGCACCCUAUCAGG | 716 |
| GGCCUUGUGGUACUGCCUG | 21 | GGCCUUGUGGUACUGCCUG | 21 | CAGGCAGUACCACAAGGCC | 717 |
| GCUUGCGAGUGCCCCGGGA | 22 | GCUUGCGAGUGCCCCGGGA | 22 | UCCCGGGGCACUCGCAAGC | 718 |
| UGCCUGAUAGGGUGCUUGC | 23 | UGCCUGAUAGGGUGCUUGC | 23 | GCAAGCACCCUAUCAGGCA | 719 |
| GAAAGGCCUUGUGGUACUG | 24 | GAAAGGCCUUGUGGUACUG | 24 | CAGUACCACAAGGCCUUUC | 720 |
| GCCUGAUAGGGUGCUUGCG | 25 | GCCUGAUAGGGUGCUUGCG | 25 | CGCAAGCACCCUAUCAGGC | 721 |
| CGAAAGGCCUUGUGGUACU | 26 | CGAAAGGCCUUGUGGUACU | 26 | AGUACCACAAGGCCUUUCG | 722 |
| GCCUUGUGGUACUGCCUGA | 27 | GCCUUGUGGUACUGCCUGA | 27 | UCAGGCAGUACCACAAGGC | 723 |
| GAGUGCCCCGGGAGGUCUC | 28 | GAGUGCCCCGGGAGGUCUC | 28 | GAGACCUCCCGGGGCACUC | 724 |
| CCCGGGAGGUCUCGUAGAC | 29 | CCCGGGAGGUCUCGUAGAC | 29 | GUCUACGAGACCUCCCGGG | 725 |
| UGCGAGUGCCCCGGGAGGU | 30 | UGCGAGUGCCCCGGGAGGU | 30 | ACCUCCCGGGGCACUCGCA | 726 |
| UGGUACUGCCUGAUAGGGU | 31 | UGGUACUGCCUGAUAGGGU | 31 | ACCCUAUCAGGCAGUACCA | 727 |
| CCGGUGAGUACACCGGAAU | 32 | CCGGUGAGUACACCGGAAU | 32 | AUUCCGGUGUACUCACCGG | 728 |
| GCGAGUGCCCCGGGAGGUC | 33 | GCGAGUGCCCCGGGAGGUC | 33 | GACCUCCCGGGGCAGUCGC | 729 |
| CGAGUGCCCCGGGAGGUCU | 34 | CGAGUGCCCCGGGAGGUCU | 34 | AGACCUCCCGGGGCACUCG | 730 |
| UGCCCCGGGAGGUCUCGUA | 35 | UGCCCCGGGAGGUCUCGUA | 35 | UACGAGACCUCCCGGGGCA | 731 |
| GUGCCCCGGGAGGUCUCGU | 36 | GUGCCCCGGGAGGUCUCGU | 36 | ACGAGACCUCCCGGGGCAC | 732 |
| AGUGCCCCGGGAGGUCUCG | 37 | AGUGCCCCGGGAGGUCUCG | 37 | CGAGACCUCCCGGGGCACU | 733 |
| CCGGGAGGUCUCGUAGACC | 38 | CCGGGAGGUCUCGUAGACC | 38 | GGUCUACGAGACCUCCCGG | 734 |
| UGAUAGGGUGCUUGCGAGU | 39 | UGAUAGGGUGCUUGCGAGU | 39 | ACUCGCAAGCACCCUAUCA | 735 |
| GUGCUUGCGAGUGCCCCGG | 40 | GUGCUUGCGAGUGCCCCGG | 40 | CCGGGGCACUCGCAAGCAC | 736 |
| AUAGGGUGCUUGCGAGUGC | 41 | AUAGGGUGCUUGCGAGUGC | 41 | GCACUCGCAAGCACCCUAU | 737 |
| GGGUGCUUGCGAGUGCCCC | 42 | GGGUGCUUGCGAGUGCCCC | 42 | GGGGCACUCGCAAGCACCC | 738 |
| CGGGAGGUCUCGUAGACCG | 43 | CGGGAGGUCUCGUAGACCG | 43 | CGGUCUACGAGACCUCCCG | 739 |
| GGGAGGUCUCGUAGACCGU | 44 | GGGAGGUCUCGUAGACCGU | 44 | ACGGUCUACGAGACCUCCC | 740 |
| GAUAGGGUGCUUGCGAGUG | 45 | GAUAGGGUGCUUGCGAGUG | 45 | CACUCGCAAGCACCCUAUC | 741 |
| GGAGGUCUCGUAGACCGUG | 46 | GGAGGUCUCGUAGACCGUG | 46 | CACGGUCUACGAGACCUCC | 742 |
| AGGGUGCUUGCGAGUGCCC | 47 | AGGGUGCUUGCGAGUGCCC | 47 | GGGCACUCGCAAGCACCCU | 743 |
| UGCUUGCGAGUGCCCCGGG | 48 | UGCUUGCGAGUGCCCCGGG | 48 | CCCGGGGCACUCGCAAGCA | 744 |
| GGUGCUUGCGAGUGCCCCG | 49 | GGUGCUUGCGAGUGCCCCG | 49 | CGGGGCACUCGCAAGCACC | 745 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| UAGGGUGCUUGCGAGUGCC | 50 | UAGGGUGCUUGCGAGUGCC | 50 | GGCACUCGCAAGCACCCUA | 746 |
| AGGUCUGGUAGACCGUGCA | 51 | AGGUCUGGUAGACCGUGCA | 51 | UGCACGGUCUACGAGACCU | 747 |
| GAGGUCUCGUAGACCGUGC | 52 | GAGGUCUCGUAGACCGUGC | 52 | GCACGGUCUACGAGACCUC | 748 |
| GGAACCGGUGAGUACACCG | 53 | GGAACCGGUGAGUACACCG | 53 | CGGUGUACUCACCGGUUCC | 749 |
| CGGAACCGGUGAGUACACC | 54 | CGGAACCGGUGAGUACACC | 54 | GGUGUACUCACCGGUUCCG | 750 |
| CGGUGAGUACACCGGAAUU | 55 | CGGUGAGUACACCGGAAUU | 55 | AAUUCCGGUGUACUCACCG | 751 |
| GCGGAACCGGUGAGUACAC | 56 | GCGGAACCGGUGAGUACAC | 56 | GUGUACUCACCGGUUCCGC | 752 |
| AACCGGUGAGUACACCGGA | 57 | AACCGGUGAGUACACCGGA | 57 | UCCGGUGUACUCACCGGUU | 753 |
| ACCGGUGAGUACACCGGAA | 58 | ACCGGUGAGUACACCGGAA | 58 | UUCCGGUGUACUCACCGGU | 754 |
| CUGCGGAACCGGUGAGUAC | 59 | CUGCGGAACCGGUGAGUAC | 59 | GUACUCACCGGUUCCGCAG | 755 |
| GUCUGCGGAACCGGUGAGU | 60 | GUCUGCGGAACCGGUGAGU | 60 | ACUCACCGGUUCCGCAGAC | 756 |
| GAACCGGUGAGUACACCGG | 61 | GAACCGGUGAGUACACCGG | 61 | CCGGUGUACUCACCGGUUC | 757 |
| UGCGGAACCGGUGAGUACA | 62 | UGCGGAACCGGUGAGUACA | 62 | UGUACUCACCGGUUCCGCA | 758 |
| UCUGCGGAACCGGUGAGUA | 63 | UCUGCGGAACCGGUGAGUA | 63 | UACUCACCGGUUCCGCAGA | 759 |
| GGGAGAGCCAUAGUGGUCU | 64 | GGGAGAGCCAUAGUGGUCU | 64 | AGACCACUAUGGCUCUCCC | 760 |
| GUGGUCUGCGGAACCGGUG | 65 | GUGGUCUGCGGAACCGGUG | 65 | CACCGGUUCCGCAGACCAC | 761 |
| GGUCUGCGGAACCGGUGAG | 66 | GGUCUGCGGAACCGGUGAG | 66 | CUCACCGGUUCCGCAGACC | 762 |
| CGGGAGAGCCAUAGUGGUC | 67 | CGGGAGAGCCAUAGUGGUC | 67 | GACCACUAUGGCUCUCCCG | 763 |
| CCGGGAGAGCCAUAGUGGU | 68 | CCGGGAGAGCCAUAGUGGU | 68 | ACCACUAUGGCUCUCCCGG | 764 |
| UGGUCUGCGGAACCGGUGA | 69 | UGGUCUGCGGAACCGGUGA | 69 | UCACCGGUUCCGCAGACCA | 765 |
| GUGAGUACACCGGAAUUGC | 70 | GUGAGUACACCGGAAUUGC | 70 | GCAAUUCCGGUGUACUCAC | 766 |
| UGAGUACACCGGAAUUGCC | 71 | UGAGUACACCGGAAUUGCC | 71 | GGCAAUUCCGGUGUACUCA | 767 |
| GGUGAGUACACCGGAAUUG | 72 | GGUGAGUACACCGGAAUUG | 72 | CAAUUCCGGUGUACUCACC | 768 |
| GAGCCAUAGUGGUCUGCGG | 73 | GAGCCAUAGUGGUCUGCGG | 73 | CCGCAGACCACUAUGGCUC | 769 |
| AGAGCCAUAGUGGUCUGCG | 74 | AGAGCCAUAGUGGUCUGCG | 74 | CGCAGACCACUAUGGCUCU | 770 |
| UAGUGGUCUGCGGAACCGG | 75 | UAGUGGUCUGCGGAACCGG | 75 | CCGGUUCCGCAGACCACUA | 771 |
| AUAGUGGUCUGCGGAACCG | 76 | AUAGUGGUCUGCGGAACCG | 76 | CGGUUCCGCAGACCACUAU | 772 |
| GAGAGCCAUAGUGGUCUGC | 77 | GAGAGCCAUAGUGGUCUGC | 77 | GCAGACCACUAUGGCUCUC | 773 |
| GCCAUAGUGGUCUGCGGAA | 78 | GCCAUAGUGGUCUGCGGAA | 78 | UUCCGCAGACCACUAUGGC | 774 |
| AGUGGUCUGCGGAACCGGU | 79 | AGUGGUCUGCGGAACCGGU | 79 | ACCGGUUCCGCAGACCACU | 775 |
| CAUAGUGGUCUGCGGAACC | 80 | CAUAGUGGUCUGCGGAACC | 80 | GGUUCCGCAGACCACUAUG | 776 |
| AGCCAUAGUGGUCUGCGGA | 81 | AGCCAUAGUGGUCUGCGGA | 81 | UCCGCAGACCACUAUGGCU | 777 |
| CCAUAGUGGUCUGCGGAAC | 82 | CCAUAGUGGUCUGCGGAAC | 82 | GUUCCGCAGACCACUAUGG | 778 |
| CCCCUCCCGGGAGAGCCAU | 83 | CCCCUCCCGGGAGAGCCAU | 83 | AUGGCUCUCCCGGGAGGGG | 779 |
| GGAGAGCCAUAGUGGUCUG | 84 | GGAGAGCCAUAGUGGUCUG | 84 | CAGACCACUAUGGCUCUCC | 780 |
| CCCGGGAGAGCCAUAGUGG | 85 | CCCGGGAGAGCCAUAGUGG | 85 | CCACUAUGGCUCUCCCGGG | 781 |
| CCCCUCCCGGGAGAGCCA | 86 | CCCCUCCCGGGAGAGCCA | 86 | UGGCUCUCCCGGGAGGGGG | 782 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| UCCCGGGAGAGCCAUAGUG | 87 | UCCCGGGAGAGCCAUAGUG | 87 | CACUAUGGCUCUCCCGGGA | 783 |
| CCCCCCUCCCGGGAGAGCC | 88 | CCCCCCUCCCGGGAGAGCC | 88 | GGCUCUCCCGGGAGGGGGG | 784 |
| CCCUCCCGGGAGAGCCAUA | 89 | CCCUCCCGGGAGAGCCAUA | 89 | UAUGGCUCUCCCGGGAGGG | 785 |
| CCUCCCGGGAGAGCCAUAG | 90 | CCUCCCGGGAGAGCCAUAG | 90 | CUAUGGCUCUCCCGGGAGG | 786 |
| CUCCCGGGAGAGCCAUAGU | 91 | CUCCCGGGAGAGCCAUAGU | 91 | AGUAUGGCUCUCCCGGGAG | 787 |
| UGUUGCCGCGCAGGGGCCC | 92 | UGUUGCCGCGCAGGGGCCC | 92 | GGGCCCCUGCGCGGCAACA | 788 |
| CCCCCCCUCCCGGGAGAGC | 93 | CCCCCCCUCCCGGGAGAGC | 93 | GCUCUCCCGGGAGGGGGGG | 789 |
| CAUGGCGUUAGUAUGAGUG | 94 | CAUGGCGUUAGUAUGAGUG | 94 | CACUCAUACUAACGCCAUG | 790 |
| UAGCCAUGGCGUUAGUAUG | 95 | UAGCCAUGGCGUUAGUAUG | 95 | CAUACUAACGCCAUGGCUA | 791 |
| AGCCAUGGCGUUAGUAUGA | 96 | AGCCAUGGCGUUAGUAUGA | 96 | UCAUACUAACGCCAUGGCU | 792 |
| CCAUGGCGUUAGUAUGAGU | 97 | CCAUGGCGUUAGUAUGAGU | 97 | ACUCAUACUAACGCCAUGG | 793 |
| AUGGCGUUAGUAUGAGUGU | 98 | AUGGCGUUAGUAUGAGUGU | 98 | ACACUCAUACUAACGCCAU | 794 |
| AAGCGUCUAGCCAUGGCGU | 99 | AAGCGUCUAGCCAUGGCGU | 99 | ACGCCAUGGCUAGACGCUU | 795 |
| GUCUAGCCAUGGCGUUAGU | 100 | GUCUAGCCAUGGCGUUAGU | 100 | ACUAACGCCAUGGCUAGAC | 796 |
| AAAGCGUCUAGCCAUGGCG | 101 | AAAGCGUCUAGCCAUGGCG | 101 | CGCCAUGGCUAGACGCUUU | 797 |
| GCGUCUAGCCAUGGCGUUA | 102 | GCGUCUAGCCAUGGCGUUA | 102 | UAACGCCAUGGCUAGACGC | 798 |
| GCCAUGGCGUUAGUAUGAG | 103 | GCCAUGGCGUUAGUAUGAG | 103 | CUCAUACUAACGCCAUGGC | 799 |
| AGCGUCUAGCCAUGGCGUU | 104 | AGCGUCUAGCCAUGGCGUU | 104 | AACGCCAUGGCUAGACGCU | 800 |
| CGUCUAGCCAUGGCGUUAG | 105 | CGUCUAGCCAUGGCGUUAG | 105 | CUAACGCCAUGGCUAGACG | 801 |
| UCUAGCCAUGGCGUUAGUA | 106 | UCUAGCCAUGGCGUUAGUA | 106 | UACUAACGCCAUGGCUAGA | 802 |
| GAAAGCGUCUAGCCAUGGC | 107 | GAAAGCGUCUAGCCAUGGC | 107 | GCCAUGGCUAGACGCUUUC | 803 |
| CUAGCCAUGGCGUUAGUAU | 108 | CUAGCCAUGGCGUUAGUAU | 108 | AUACUAACGCCAUGGCUAG | 804 |
| CACUCCCCUGUGAGGAACU | 109 | CACUCCCCUGUGAGGAACU | 109 | AGUUCCUCACAGGGGAGUG | 805 |
| ACCUCAAAGAAAACCAAA | 110 | ACCUCAAAGAAAACCAAA | 110 | UUUGGUUUUCUUUGAGGU | 806 |
| CGCAGAAAGCGUCUAGCCA | 111 | CGCAGAAAGCGUCUAGCCA | 111 | UGGCUAGACGCUUUCUGCG | 807 |
| GGGUAAGGUCAUCGAUACC | 112 | GGGUAAGGUCAUCGAUACC | 112 | GGUAUCGAUGACCUUACCC | 808 |
| CAGAAAGCGUCUAGCCAUG | 113 | CAGAAAGCGUCUAGCCAUG | 113 | CAUGGCUAGACGCUUUCUG | 809 |
| AAACCUCAAAGAAAACCA | 114 | AAACCUCAAAGAAAACCA | 114 | UGGUUUUCUUUGAGGUUU | 810 |
| GCAGAAAGCGUCUAGCCAU | 115 | GCAGAAAGCGUCUAGCCAU | 115 | AUGGCUAGACGCUUUCUGC | 811 |
| AGAAAGCGUCUAGCCAUGG | 116 | AGAAAGCGUCUAGCCAUGG | 116 | CCAUGGCUAGACGCUUUCU | 812 |
| ACGCAGAAAGCGUCUAGCC | 117 | ACGCAGAAAGCGUCUAGCC | 117 | GGCUAGACGCUUUCUGCGU | 813 |
| AACCUCAAAGAAAACCAA | 118 | AACCUCAAAGAAAACCAA | 118 | UUGGUUUUCUUUGAGGUU | 814 |
| UGGGUAAGGUCAUCGAUAC | 119 | UGGGUAAGGUCAUCGAUAC | 119 | GUAUCGAUGACCUUACCCA | 815 |
| GUAAGGUCAUCGAUACCCU | 120 | GUAAGGUCAUCGAUACCCU | 120 | AGGGUAUCGAUGACCUUAC | 816 |
| UUCACGCAGAAAGCGUCUA | 121 | UUCACGCAGAAAGCGUCUA | 121 | UAGACGCUUUGUGCGUGAA | 817 |
| GGUAAGGUCAUCGAUACCC | 122 | GGUAAGGUCAUCGAUACCC | 122 | GGGUAUCGAUGACCUUACC | 818 |
| AUCACUCCCCUGUGAGGAA | 123 | AUCACUCCCCUGUGAGGAA | 123 | UUCCUCACAGGGGAGUGAU | 819 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| UCACUCCCUGUGAGGAAC | 124 | UCACUCCCUGUGAGGAAC | 124 | GUUCCUCACAGGGGAGUGA | 820 |
| UGUCUUCACGCAGAAAGCG | 125 | UGUCUUCACGCAGAAAGCG | 125 | CGCUUUCUGCGUGAAGACA | 821 |
| UCACGCAGAAAGCGUCUAG | 126 | UCACGCAGAAAGCGUCUAG | 126 | CUAGACGCUUUCUGCGUGA | 822 |
| CACGCAGAAAGCGUCUAGC | 127 | CACGCAGAAAGCGUCUAGC | 127 | GCUAGACGCUUUCUGCGUG | 823 |
| GACCGGGUCCUUUCUUGGA | 128 | GACCGGGUCCUUUCUUGGA | 128 | UCCAAGAAAGGACCCGGUC | 824 |
| GAGGAACUACUGUCUUCAC | 129 | GAGGAACUACUGUCUUCAC | 129 | GUGAAGACAGUAGUUCCUC | 825 |
| CUGUGAGGAACUACUGUCU | 130 | CUGUGAGGAACUACUGUCU | 130 | AGACAGUAGUUCCUCACAG | 826 |
| GGAACUACUGUCUUCACGC | 131 | GGAACUACUGUCUUCACGC | 131 | GCGUGAAGACAGUAGUUCC | 827 |
| ACUCCCCUGUGAGGAACUA | 132 | ACUCCCCUGUGAGGAACUA | 132 | UAGUUCCUCACAGGGGAGU | 828 |
| GUCUUCACGCAGAAAGCGU | 133 | GUCUUCACGCAGAAAGCGU | 133 | ACGCUUUCUGCGUGAAGAC | 829 |
| AGGAACUACUGUCUUCACG | 134 | AGGAACUACUGUCUUCACG | 134 | CGUGAAGACAGUAGUUCCU | 830 |
| CCUGUGAGGAACUACUGUC | 135 | CCUGUGAGGAACUACUGUC | 135 | GACAGUAGUUCCUCACAGG | 831 |
| UGUGAGGAACUACUGUCUU | 136 | UGUGAGGAACUACUGUCUU | 136 | AAGACAGUAGUUCCUCACA | 832 |
| UCUUCACGCAGAAAGCGUC | 137 | UCUUCACGCAGAAAGCGUC | 137 | GACGCUUUCUGCGUGAAGA | 833 |
| GAACUACUGUCUUCACGCA | 138 | GAACUACUGUCUUCACGCA | 138 | UGCGUGAAGACAGUAGUUC | 834 |
| CCCUGUGAGGAACUACUGU | 139 | CCCUGUGAGGAACUACUGU | 139 | ACAGUAGUUCCUCACAGGG | 835 |
| CUUCACGCAGAAAGCGUCU | 140 | CUUCACGCAGAAAGCGUCU | 140 | AGACGCUUUCUGCGUGAAG | 836 |
| UGAGGAACUACUGUCUUCA | 141 | UGAGGAACUACUGUCUUCA | 141 | UGAAGACAGUAGUUCCUCA | 837 |
| UGGCGUUAGUAUGAGUGUC | 142 | UGGCGUUAGUAUGAGUGUC | 142 | GACACUCAUACUAACGCCA | 838 |
| CCCCUGUGAGGAACUACUG | 143 | CCCCUGUGAGGAACUACUG | 143 | CAGUAGUUCCUCACAGGGG | 839 |
| GUGAGGAACUACUGUCUUC | 144 | GUGAGGAACUACUGUCUUC | 144 | GAAGACAGUAGUUCCUCAC | 840 |
| GGCGUUAGUAUGAGUGUCG | 145 | GGCGUUAGUAUGAGUGUCG | 145 | CGACACUCAUACUAACGCC | 841 |
| GCCGAGUAGUGUUGGGUCG | 146 | GCCGAGUAGUGUUGGGUCG | 146 | CGACCCAACACUACUCGGC | 842 |
| ACUGUCUUCACGCAGAAAG | 147 | ACUGUCUUCACGCAGAAAG | 147 | CUUUCUGCGUGAAGACAGU | 843 |
| UGGGUCGCGAAAGGCCUUG | 148 | UGGGUCGCGAAAGGCCUUG | 148 | CAAGGCCUUUCGCGACCCA | 844 |
| CUACUGUCUUCACGCAGAA | 149 | CUACUGUCUUCACGCAGAA | 149 | UUCUGCGUGAAGACAGUAG | 845 |
| CGAGUAGUGUUGGGUCGCG | 150 | CGAGUAGUGUUGGGUCGCG | 150 | CGCGACCCAACACUACUCG | 846 |
| GUAGUGUUGGGUCGCGAAA | 151 | GUAGUGUUGGGUCGCGAAA | 151 | UUUCGCGACCCAACACUAC | 847 |
| UAAACCUCAAAGAAAAACC | 152 | UAAACCUCAAAGAAAAACC | 152 | GGUUUUUCUUUGAGGUUUA | 848 |
| CCGAGUAGUGUUGGGUCGC | 153 | CCGAGUAGUGUUGGGUCGC | 153 | GCGACCCAACACUACUCGG | 849 |
| AGCCGAGUAGUGUUGGGUC | 154 | AGCCGAGUAGUGUUGGGUC | 154 | GACCCAACACUACUCGGCU | 850 |
| GUCGCGAAAGGCCUUGUGG | 155 | GUCGCGAAAGGCCUUGUGG | 155 | CCACAAGGCCUUUCGCGAC | 851 |
| UAGUGUUGGGUCGCGAAAG | 156 | UAGUGUUGGGUCGCGAAAG | 156 | CUUUCGCGACCCAACACUA | 852 |
| CUAGCCGAGUAGUGUUGGG | 157 | CUAGCCGAGUAGUGUUGGG | 157 | CCCAACACUACUCGGCUAG | 853 |
| GAGUAGUGUUGGGUCGCGA | 158 | GAGUAGUGUUGGGUCGCGA | 158 | UCGCGACCCAACACUACUC | 854 |
| UCGCGAAAGGCCUUGUGGU | 159 | UCGCGAAAGGCCUUGUGGU | 159 | ACCACAAGGCCUUUCGCGA | 855 |
| GCGUUAGUAUGAGUGUCGU | 160 | GCGUUAGUAUGAGUGUCGU | 160 | ACGACACUCAUACUAACGC | 856 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| UAGCCGAGUAGUGUUGGGU | 161 | UAGCCGAGUAGUGUUGGGU | 161 | ACCCAACACUACUCGGCUA | 857 |
| AACUACUGUCUUCACGCAG | 162 | AACUACUGUCUUCACGCAG | 162 | CUGCGUGAAGACAGUAGUU | 858 |
| CGCGAAAGGCCUUGUGGUA | 163 | CGCGAAAGGCCUUGUGGUA | 163 | UACCACAAGGCCUUUCGCG | 859 |
| AGUGUUGGGUCGCGAAAGG | 164 | AGUGUUGGGUCGCGAAAGG | 164 | CCUUUCGCGACCCAACACU | 860 |
| GUUGGGUCGCGAAAGGCCU | 165 | GUUGGGUCGCGAAAGGCCU | 165 | AGGCCUUUCGCGACCCAAC | 861 |
| AGUAGUGUUGGGUCGCGAA | 166 | AGUAGUGUUGGGUCGCGAA | 166 | UUCGCGACCCAACACUACU | 862 |
| UUGGGUCGCGAAAGGCCUU | 167 | UUGGGUCGCGAAAGGCCUU | 167 | AAGGCCUUUCGCGACCCAA | 863 |
| UCCCCUGUGAGGAACUACU | 168 | UCCCCUGUGAGGAACUACU | 168 | AGUAGUUCCUCACAGGGGA | 864 |
| UACUGUCUUCACGCAGAAA | 169 | UACUGUCUUCACGCAGAAA | 169 | UUUCUGCGUGAAGACAGUA | 865 |
| GUGUUGGGUCGCGAAAGGC | 170 | GUGUUGGGUCGCGAAAGGC | 170 | GCCUUUCGCGACCCAACAC | 866 |
| ACUACUGUCUUCACGCAGA | 171 | ACUACUGUCUUCACGCAGA | 171 | UCUGCGUGAAGACAGUAGU | 867 |
| CUGUCUUCACGCAGAAAGC | 172 | CUGUCUUCACGCAGAAAGC | 172 | GCUUUCUGCGUGAAGACAG | 868 |
| GGGUCGCGAAAGGCCUUGU | 173 | GGGUCGCGAAAGGCCUUGU | 173 | ACAAGGCCUUUCGCGACCC | 869 |
| CCUAAACCUCAAAGAAAAA | 174 | CCUAAACCUCAAAGAAAAA | 174 | UUUUUCUUUGAGGUUUAGG | 870 |
| GGUCGCGAAAGGCCUUGUG | 175 | GGUCGCGAAAGGCCUUGUG | 175 | CACAAGGCCUUUCGCGACC | 871 |
| CUAAACCUCAAAGAAAAAC | 176 | CUAAACCUCAAAGAAAAAC | 176 | GUUUUUCUUUGAGGUUUAG | 872 |
| UGUUGGGUCGCGAAAGGCC | 177 | UGUUGGGUCGCGAAAGGCC | 177 | GGCCUUUCGCGACCCAACA | 873 |
| CUCCCCUGUGAGGAACUAC | 178 | CUCCCCUGUGAGGAACUAC | 178 | GUAGUUCCUCACAGGGGAG | 874 |
| UCCUAAACCUCAAAGAAAA | 179 | UCCUAAACCUCAAAGAAAA | 179 | UUUUCUUUGAGGUUUAGGA | 875 |
| ACCGGGUCCUUUCUUGGAU | 180 | ACCGGGUCCUUUCUUGGAU | 180 | AUCCAAGAAAGGACCCGGU | 876 |
| AAUCCUAAACCUCAAAGAA | 181 | AAUCCUAAACCUCAAAGAA | 181 | UUCUUUGAGGUUUAGGAUU | 877 |
| UCAAUGCCUGGAGAUUUGG | 182 | UCAAUGCCUGGAGAUUUGG | 182 | CCAAAUCUCCAGGCAUUGA | 878 |
| AUGCCUGGAGAUUUGGGCG | 183 | AUGCCUGGAGAUUUGGGCG | 183 | CGCCCAAAUCUCCAGGCAU | 879 |
| AAUGCCUGGAGAUUUGGGC | 184 | AAUGCCUGGAGAUUUGGGC | 184 | GCCCAAAUCUCCAGGCAUU | 880 |
| CCGACCUCAUGGGGUACAU | 185 | CCGACCUCAUGGGGUACAU | 185 | AUGUACCCCAUGAGGUCGG | 881 |
| GCUCAAUGCCUGGAGAUUU | 186 | GCUCAAUGCCUGGAGAUUU | 186 | AAAUCUCCAGGCAUUGAGC | 882 |
| CUCAAUGCCUGGAGAUUUG | 187 | CUCAAUGCCUGGAGAUUUG | 187 | CAAAUCUCCAGGCAUUGAG | 883 |
| GCUAGCCGAGUAGUGUUGG | 188 | GCUAGCCGAGUAGUGUUGG | 188 | CCAACACUACUCGGCUAGC | 884 |
| CGCUCAAUGCCUGGAGAUU | 189 | CGCUCAAUGCCUGGAGAUU | 189 | AAUCUCCAGGCAUUGAGCG | 885 |
| CAAUGCCUGGAGAUUUGGG | 190 | CAAUGCCUGGAGAUUUGGG | 190 | CCCAAAUCUCCAGGCAUUG | 886 |
| GCCGACCUCAUGGGGUACA | 191 | GCCGACCUCAUGGGGUACA | 191 | UGUACCCCAUGAGGUCGGC | 887 |
| AUCCUAAACCUCAAAGAAA | 192 | AUCCUAAACCUCAAAGAAA | 192 | UUUCUUUGAGGUUUAGGAU | 888 |
| AGAUUUGGGCGUGCCCCCG | 193 | AGAUUUGGGCGUGCCCCCG | 193 | CGGGGGCACGCCCAAAUCU | 889 |
| CCCGCUCAAUGCCUGGAGA | 194 | CCCGCUCAAUGCCUGGAGA | 194 | UCUCCAGGCAUUGAGCGGG | 890 |
| GAGAUUUGGGCGUGCCCCC | 195 | GAGAUUUGGGCGUGCCCCC | 195 | GGGGGCACGCCCAAAUCUC | 891 |
| GGAGAUUUGGGCGUGCCCC | 196 | GGAGAUUUGGGCGUGCCCC | 196 | GGGGCACGCCCAAAUCUCC | 892 |
| GAUUUGGGCGUGCCCCCGC | 197 | GAUUUGGGCGUGCCCCCGC | 197 | GCGGGGGCACGCCCAAAUC | 893 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| CCGCUCAAUGCCUGGAGAU | 198 | CCGCUCAAUGCCUGGAGAU | 198 | AUCUCCAGGCAUUGAGCGG | 894 |
| AGUACACCGGAAUUGCCAG | 199 | AGUACACCGGAAUUGCCAG | 199 | CUGGCAAUUCCGGUGUACU | 895 |
| UACACCGGAAUUGCCAGGA | 200 | UACACCGGAAUUGCCAGGA | 200 | UCCUGGCAAUUCCGGUGUA | 896 |
| GAGUACACCGGAAUUGCCA | 201 | GAGUACACCGGAAUUGCCA | 201 | UGGCAAUUCCGGUGUACUC | 897 |
| GUACACCGGAAUUGCCAGG | 202 | GUACACCGGAAUUGCCAGG | 202 | CCUGGCAAUUCCGGUGUAC | 898 |
| UUGCCGCGCAGGGGCCCCA | 203 | UUGCCGCGCAGGGGCCCCA | 203 | UGGGGCCCCUGCGCGGCAA | 899 |
| CUGGAGAUUUGGGCGUGCC | 204 | CUGGAGAUUUGGGCGUGCC | 204 | GGCACGCCCAAAUCUCCAG | 900 |
| GUUGCCGCGCAGGGGCCCC | 205 | GUUGCCGCGCAGGGGCCCC | 205 | GGGGCCCCUGCGCGGCAAC | 901 |
| GCCUGGAGAUUUGGGCGUG | 206 | GCCUGGAGAUUUGGGCGUG | 206 | CACGCCCAAAUCUCCAGGC | 902 |
| UGGAGAUUUGGGCGUGCCC | 207 | UGGAGAUUUGGGCGUGCCC | 207 | GGGCACGCCCAAAUCUCCA | 903 |
| CCUGGAGAUUUGGGCGUGC | 208 | CCUGGAGAUUUGGGCGUGC | 208 | GCACGCCCAAAUCUCCAGG | 904 |
| UGCUAGCCGAGUAGUGUUG | 209 | UGCUAGCCGAGUAGUGUUG | 209 | CAACACUACUCGGCUAGCA | 905 |
| UGCCUGGAGAUUUGGGCGU | 210 | UGCCUGGAGAUUUGGGCGU | 210 | ACGCCCAAAUCUCCAGGCA | 906 |
| CUGCUAGCCGAGUAGUGUU | 211 | CUGCUAGCCGAGUAGUGUU | 211 | AACACUACUCGGCUAGCAG | 907 |
| ACUGCUAGCCGAGUAGUGU | 212 | ACUGCUAGCCGAGUAGUGU | 212 | ACACUACUCGGCUAGCAGU | 908 |
| GACUGCUAGCCGAGUAGUG | 213 | GACUGCUAGCCGAGUAGUG | 213 | CACUACUCGGCUAGCAGUC | 909 |
| AGACUGCUAGCCGAGUAGU | 214 | AGACUGCUAGCCGAGUAGU | 214 | ACUACUCGGCUAGCAGUCU | 910 |
| ACCCGCUCAAUGCCUGGAG | 215 | ACCCGCUCAAUGCCUGGAG | 215 | CUCCAGGCAUUGAGCGGGU | 911 |
| AACCCGCUCAAUGCCUGGA | 216 | AACCCGCUCAAUGCCUGGA | 216 | UCCAGGCAUUGAGCGGGUU | 912 |
| UGCCGCGCAGGGGCCCCAG | 217 | UGCCGCGCAGGGGCCCCAG | 217 | CUGGGGCCCCUGCGCGGCA | 913 |
| AGGGGCCCCAGGUUGGGUG | 218 | AGGGGCCCCAGGUUGGGUG | 218 | CACCCAACCUGGGGCCCCU | 914 |
| GGGCCCCAGGUUGGGUGUG | 219 | GGGCCCCAGGUUGGGUGUG | 219 | CACACCCAACCUGGGGCCC | 915 |
| CAGGGGCCCCAGGUUGGGU | 220 | CAGGGGCCCCAGGUUGGGU | 220 | ACCCAACCUGGGGCCCCUG | 916 |
| GGCCCCAGGUUGGGUGUGC | 221 | GGCCCCAGGUUGGGUGUGC | 221 | GCACACCCAACCUGGGGCC | 917 |
| CGCAGGGGCCCCAGGUUGG | 222 | CGCAGGGGCCCCAGGUUGG | 222 | CCAACCUGGGGCCCCUGCG | 918 |
| UGGGCAGGAUGGCUCCUGU | 223 | UGGGCAGGAUGGCUCCUGU | 223 | ACAGGAGCCAUCCUGCCCA | 919 |
| GCCCCAGGUUGGGUGUGCG | 224 | GCCCCAGGUUGGGUGUGCG | 224 | CGCACACCCAACCUGGGGC | 920 |
| GCAGGGGCCCCAGGUUGGG | 225 | GCAGGGGCCCCAGGUUGGG | 225 | CCCAACCUGGGGCCCCUGC | 921 |
| GGGCAGGAUGGCUCCUGUC | 226 | GGGCAGGAUGGCUCCUGUC | 226 | GACAGGAGCCAUCCUGCCC | 922 |
| GGGGCCCCAGGUUGGGUGU | 227 | GGGGCCCCAGGUUGGGUGU | 227 | ACACCCAACCUGGGGCCCC | 923 |
| GCCGCGCAGGGGCCCCAGG | 228 | GCCGCGCAGGGGCCCCAGG | 228 | CCUGGGGCCCCUGCGCGGC | 924 |
| GCGCAGGGGCCCCAGGUUG | 229 | GCGCAGGGGCCCCAGGUUG | 229 | CAACCUGGGGCCCCUGCGC | 925 |
| CGCGCAGGGGCCCCAGGUU | 230 | CGCGCAGGGGCCCCAGGUU | 230 | AACCUGGGGCCCCUGCGCG | 926 |
| CCGCGCAGGGGCCCCAGGU | 231 | CCGCGCAGGGGCCCCAGGU | 231 | ACCUGGGGCCCCUGCGCGG | 927 |
| AGGACGACCGGGUCCUUUC | 232 | AGGACGACCGGGUCCUUUC | 232 | GAAAGGACCCGGUCGUCCU | 928 |
| CAGGACGACCGGGUCCUUU | 233 | CAGGACGACCGGGUCCUUU | 233 | AAAGGACCCGGUCGUCCUG | 929 |
| UGCCAGGACGACCGGGUCC | 234 | UGCCAGGACGACCGGGUCC | 234 | GGACCCGGUCGUCCUGGCA | 930 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| AUUGCCAGGACGACCGGGU | 235 | AUUGCCAGGACGACCGGGU | 235 | ACCCGGUCGUCCUGGCAAU | 931 |
| AAUUGCCAGGACGACCGGG | 236 | AAUUGCCAGGACGACCGGG | 236 | CCCGGUCGUCCUGGCAAUU | 932 |
| UUGCCAGGACGACCGGGUC | 237 | UUGCCAGGACGACCGGGUC | 237 | GACCCGGUCGUCCUGGCAA | 933 |
| CCAGGACGACCGGGUCCUU | 238 | CCAGGACGACCGGGUCCUU | 238 | AAGGACCCGGUCGUCCUGG | 934 |
| GCCAGGACGACCGGGUCCU | 239 | GCCAGGACGACCGGGUCCU | 239 | AGGACCCGGUCGUCCUGGC | 935 |
| GAAUUGCCAGGACGACCGG | 240 | GAAUUGCCAGGACGACCGG | 240 | CCGGUCGUCCUGGCAAUUC | 936 |
| ACGACCGGGUCCUUUCUUG | 241 | ACGACCGGGUCCUUUCUUG | 241 | CAAGAAAGGACCCGGUCGU | 937 |
| GACGACCGGGUCCUUUCUU | 242 | GACGACCGGGUCCUUUCUU | 242 | AAGAAAGGACCCGGUCGUC | 938 |
| GGACCGGGUCCUUUCUUGG | 243 | GGACCGGGUCCUUUCUUGG | 243 | CCAAGAAAGGACCCGGUCG | 939 |
| GGACGACCGGGUCCUUUCU | 244 | GGACGACCGGGUCCUUUCU | 244 | AGAAAGGACCCGGUCGUCC | 940 |
| CCGGAAUUGCCAGGACGAC | 245 | CCGGAAUUGCCAGGACGAC | 245 | GUCGUCCUGGCAAUUCCGG | 941 |
| ACACCGGAAUUGCCAGGAC | 246 | ACACCGGAAUUGCCAGGAC | 246 | GUCCUGGCAAUUCCGGUGU | 942 |
| ACCGGAAUUGCCAGGACGA | 247 | ACCGGAAUUGCCAGGACGA | 247 | UCGUCCUGGCAAUUCCGGU | 943 |
| CGGAAUUGCCAGGACGACC | 248 | CGGAAUUGCCAGGACGACC | 248 | GGUCGUCCUGGCAAUUCCG | 944 |
| GGAAUUGCCAGGACGACCG | 249 | GGAAUUGCCAGGACGACCG | 249 | CGGUCGUCCUGGCAAUUCC | 945 |
| CACCGGAAUUGCCAGGACG | 250 | CACCGGAAUUGCCAGGACG | 250 | CGUCCUGGCAAUUCCGGUG | 946 |
| CCCCAGGUUGGGUGUGCGC | 251 | CCCCAGGUUGGGUGUGCGC | 251 | GCGCACACCCAACCUGGGG | 947 |
| GAUCGUUGGUGGAGUUUAC | 252 | GAUCGUUGGUGGAGUUUAC | 252 | GUAAACUCCACCAACGAUC | 948 |
| CAGAUCGUUGGUGGAGUUU | 253 | CAGAUCGUUGGUGGAGUUU | 253 | AAACUCCACCAACGAUCUG | 949 |
| AGAUCGUUGGUGGAGUUUA | 254 | AGAUCGUUGGUGGAGUUUA | 254 | UAAACUCCACCAACGAUCU | 950 |
| CCCAGGUUGGGUGUGCGCG | 255 | CCCAGGUUGGGUGUGCGCG | 255 | CGCGCACACCCAACCUGGG | 951 |
| CCAGGUUGGGUGUGCGCGC | 256 | CCAGGUUGGGUGUGCGCGC | 256 | GCGCGCACACCCAACCUGG | 952 |
| AGGUUGGGUGUGCGCGCGA | 257 | AGGUUGGGUGUGCGCGCGA | 257 | UCGCGCGCACACCCAACCU | 953 |
| CAGGUUGGGUGUGCGCGCG | 258 | CAGGUUGGGUGUGCGCGCG | 258 | CGCGCGCACACCCAACCUG | 954 |
| GGUUGGGUGUGCGCGCGAC | 259 | GGUUGGGUGUGCGCGCGAC | 259 | GUCGCGCGCACACCCAACC | 955 |
| GAAAAACCAAACGUAACAC | 260 | GAAAAACCAAACGUAACAC | 260 | GUGUUACGUUUGGUUUUUC | 956 |
| AGAAAAACCAAACGUAACA | 261 | AGAAAAACCAAACGUAACA | 261 | UGUUACGUUUGGUUUUUCU | 957 |
| AACCAAACGUAACACCAAC | 262 | AACCAAACGUAACACCAAC | 262 | GUUGGUGUUACGUUUGGUU | 958 |
| AAAGAAAAACCAAACGUAA | 263 | AAAGAAAAACCAAACGUAA | 263 | UUACGUUUGGUUUUUCUUU | 959 |
| AAAAACCAAACGUAACACC | 264 | AAAAACCAAACGUAACACC | 264 | GGUGUUACGUUUGGUUUUU | 960 |
| AAGAAAAACCAAACGUAAC | 265 | AAGAAAAACCAAACGUAAC | 265 | GUUACGUUUGGUUUUUCUU | 961 |
| CAAAGAAAAACCAAACGUA | 266 | CAAAGAAAAACCAAACGUA | 266 | UACGUUUGGUUUUUCUUUG | 962 |
| ACCCCCGGCGUAGGUCGCG | 267 | ACCCCCGGCGUAGGUCGCG | 267 | CGGGACCUACGCCGGGGGU | 963 |
| GACCCCCGGCGUAGGUCGC | 268 | GACCCCCGGCGUAGGUCGC | 268 | GCGACCUACGCCGGGGGUC | 964 |
| CGUUAGUAUGAGUGUCGUG | 269 | CGUUAGUAUGAGUGUCGUG | 269 | CACGACACUCAUACUAACG | 965 |
| GUUAGUAUGAGUGUCGUGC | 270 | GUUAGUAUGAGUGUCGUGC | 270 | GCACGACACUCAUACUAAC | 966 |
| UUAGUAUGAGUGUCGUGCA | 271 | UUAGUAUGAGUGUCGUGCA | 271 | UGCACGACACUCAUACUAA | 967 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| CCAAACGUAACACCAACCG | 272 | CCAAACGUAACACCAACCG | 272 | CGGUUGGUGUUACGUUUGG | 968 |
| ACCAAACGUAACACCAACC | 273 | ACCAAACGUAACACCAACC | 273 | GGUUGGUGUUACGUUUGGU | 969 |
| UUGGGCGUGCCCCCGCGAG | 274 | UUGGGCGUGCCCCCGCGAG | 274 | CUCGCGGGGGCACGCCCAA | 970 |
| AUUUGGGCGUGCCCCCGCG | 275 | AUUUGGGCGUGCCCCCGCG | 275 | CGCGGGGGCACGCCCAAAU | 971 |
| UUUGGGCGUGCCCCCGCGA | 276 | UUUGGGCGUGCCCCCGCGA | 276 | UCGCGGGGGCACGCCCAAA | 972 |
| AAACCAAACGUAACACCAA | 277 | AAACCAAACGUAACACCAA | 277 | UUGGUGUUACGUUUGGUUU | 973 |
| UGGGCGUGCCCCCGCGAGA | 278 | UGGGCGUGCCCCCGCGAGA | 278 | UCUCGCGGGGCACGCCCA | 974 |
| GUCAGAUCGUUGGUGGAGU | 279 | GUCAGAUCGUUGGUGGAGU | 279 | ACUCCACCAACGAUCUGAC | 975 |
| GUGUCGUGCAGCCUCCAGG | 280 | GUGUCGUGCAGCCUCCAGG | 280 | CCUGGAGGCUGCACGACAC | 976 |
| GGUCAGAUCGUUGGUGGAG | 281 | GGUCAGAUCGUUGGUGGAG | 281 | CUCCACCAACGAUCUGACC | 977 |
| AGUGUCGUGCAGCCUCCAG | 282 | AGUGUCGUGCAGCCUCCAG | 282 | CUGGAGGCUGCACGACACU | 978 |
| GAGUGUCGUGCAGCCUCCA | 283 | GAGUGUCGUGCAGCCUCCA | 283 | UGGAGGCUGCACGACACUC | 979 |
| UCGUAGACCGUGCACCAUG | 284 | UCGUAGACCGUGCACCAUG | 284 | CAUGGUGCACGGUCUACGA | 980 |
| GACCGUGCACCAUGAGCAC | 285 | GACCGUGCACCAUGAGCAC | 285 | GUGCUCAUGGUGCACGGUC | 981 |
| AGUAUGAGUGUCGUGCAGC | 286 | AGUAUGAGUGUCGUGCAGC | 286 | GCUGCACGACACUCAUACU | 982 |
| UAGUAUGAGUGUCGUGCAG | 287 | UAGUAUGAGUGUCGUGCAG | 287 | CUGCACGACACUCAUACUA | 983 |
| UCAGAUCGUUGGUGGAGUU | 288 | UCAGAUCGUUGGUGGAGUU | 288 | AACUCCACCAACGAUCUGA | 984 |
| AGACCGUGCACCAUGAGCA | 289 | AGACCGUGCACCAUGAGCA | 289 | UGCUCAUGGUGCACGGUCU | 985 |
| AAAACCAAACGUAACACCA | 290 | AAAACCAAACGUAACACCA | 290 | UGGUGUUACGUUUGGUUUU | 986 |
| GUAGACCGUGCACCAUGAG | 291 | GUAGACCGUGCACCAUGAG | 291 | CUCAUGGUGCACGGUCUAC | 987 |
| CUCGUAGACCGUGCACCAU | 292 | CUCGUAGACCGUGCACCAU | 292 | AUGGUGCACGGUCUACGAG | 988 |
| CGUAGACCGUGCACCAUGA | 293 | CGUAGACCGUGCACCAUGA | 293 | UCAUGGUGCACGGUCUACG | 989 |
| CCUGGGCUCAGCCCGGGUA | 294 | CCUGGGCUCAGCCCGGGUA | 294 | UACCCGGGCUGAGCCCAGG | 990 |
| UAGACCGUGCACCAUGAGC | 295 | UAGACCGUGCACCAUGAGC | 295 | GCUCAUGGUGCACGGUCUA | 991 |
| GGUCUCGUAGACCGUGCAC | 296 | GGUCUCGUAGACCGUGCAC | 296 | GUGCACGGUCUACGAGACC | 992 |
| UCUCGUAGACCGUGCACCA | 297 | UCUCGUAGACCGUGCACCA | 297 | UGGUGCACGGUCUACGAGA | 993 |
| GUCUCGUAGACCGUGCACC | 298 | GUCUCGUAGACCGUGCACC | 298 | GGUGCACGGUCUACGAGAC | 994 |
| UUGGGUAAGGUCAUCGAUA | 299 | UUGGGUAAGGUCAUCGAUA | 299 | UAUCGAUGACCUUACCCAA | 995 |
| UCGCCGACCUCAUGGGGUA | 300 | UCGCCGACCUCAUGGGGUA | 300 | UACCCCAUGAGGUCGGCGA | 996 |
| CCUCAAAGAAAACCAAAC | 301 | CCUCAAAGAAAACCAAAC | 301 | GUUUGGUUUUCUUUGAGG | 997 |
| GGGCGUGCCCCCGCGAGAC | 302 | GGGCGUGCCCCCGCGAGAC | 302 | GUCUCGCGGGGCACGCCC | 998 |
| GGAUGAACCGGCUGAUAGC | 303 | GGAUGAACCGGCUGAUAGC | 303 | GCUAUCAGCCGGUUCAUCC | 999 |
| UGGAUGAACCGGCUGAUAG | 304 | UGGAUGAACCGGCUGAUAG | 304 | CUAUCAGCCGGUUCAUCCA | 1000 |
| CUCAAAGAAAACCAAACG | 305 | CUCAAAGAAAACCAAACG | 305 | CGUUUGGUUUUCUUUGAG | 1001 |
| AGGAAGACUUCCGAGCGGU | 306 | AGGAAGACUUCCGAGCGGU | 306 | ACCGCUCGGAAGUCUUCCU | 1002 |
| UCAAAGAAAACCAAACGU | 307 | UCAAAGAAAACCAAACGU | 307 | ACGUUUGGUUUUCUUUGA | 1003 |
| GGAAGACUUCCGAGCGGUC | 308 | GGAAGACUUCCGAGCGGUC | 308 | GACCGCUCGGAAGUCUUCC | 1004 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| CGCCGACCUCAUGGGGUAC | 309 | CGCCGACCUCAUGGGGUAC | 309 | GUACCCCAUGAGGUCGGCG | 1005 |
| CUUCCGAGCGGUCGCAACC | 310 | CUUCCGAGCGGUCGCAACC | 310 | GGUUGCGACCGCUCGGAAG | 1006 |
| GGCGUGCCCCGCGAGACU | 311 | GGCGUGCCCCGCGAGACU | 311 | AGUCUCGCGGGGCACGCC | 1007 |
| UAUGAGUGUCGUGCAGCCU | 312 | UAUGAGUGUCGUGCAGCCU | 312 | AGGCUGCACGACACUCAUA | 1008 |
| UGCCCCGCGAGACUGCUA | 313 | UGCCCCGCGAGACUGCUA | 313 | UAGCAGUCUCGCGGGGGCA | 1009 |
| CGAGACUGCUAGCCGAGUA | 314 | CGAGACUGCUAGCCGAGUA | 314 | UACUCGGCUAGCAGUCUCG | 1010 |
| UGAGUGUCGUGCAGCCUCC | 315 | UGAGUGUCGUGCAGCCUCC | 315 | GGAGGCUGCACGACACUCA | 1011 |
| GCCCCGCGAGACUGCUAG | 316 | GCCCCGCGAGACUGCUAG | 316 | CUAGCAGUCUCGCGGGGGC | 1012 |
| GAGACUGCUAGCCGAGUAG | 317 | GAGACUGCUAGCCGAGUAG | 317 | CUACUCGGCUAGCAGUCUC | 1013 |
| CCCCGCGAGACUGCUAGC | 318 | CCCCGCGAGACUGCUAGC | 318 | GCUAGCAGUCUCGCGGGGG | 1014 |
| CGCGAGACUGCUAGCCGAG | 319 | CGCGAGACUGCUAGCCGAG | 319 | CUCGGCUAGCAGUCUCGCG | 1015 |
| GUAUGAGUGUCGUGCAGCC | 320 | GUAUGAGUGUCGUGCAGCC | 320 | GGCUGCACGACACUCAUAC | 1016 |
| AUGAGUGUCGUGCAGCCUC | 321 | AUGAGUGUCGUGCAGCCUC | 321 | GAGGCUGCACGACACUCAU | 1017 |
| GCGAGACUGCUAGCCGAGU | 322 | GCGAGACUGCUAGCCGAGU | 322 | ACUCGGCUAGCAGUCUCGC | 1018 |
| CCCCGCGAGACUGCUAGCC | 323 | CCCCGCGAGACUGCUAGCC | 323 | GGCUAGCAGUCUCGCGGGG | 1019 |
| CCGCGAGACUGCUAGCCGA | 324 | CCGCGAGACUGCUAGCCGA | 324 | UCGGCUAGCAGUCUCGCGG | 1020 |
| CCCGCGAGACUGCUAGCCG | 325 | CCCGCGAGACUGCUAGCCG | 325 | CGGCUAGCAGUCUCGCGGG | 1021 |
| GCGUGCCCCGCGAGACUG | 326 | GCGUGCCCCGCGAGACUG | 326 | CAGUCUCGCGGGGCACGC | 1022 |
| GACCCCCCUCCCGGGAGA | 327 | GACCCCCCUCCCGGGAGA | 327 | UCUCCCGGGAGGGGGGUC | 1023 |
| CGGGUCCUUUCUUGGAUCA | 328 | CGGGUCCUUUCUUGGAUCA | 328 | UGAUCCAAGAAAGGACCCG | 1024 |
| GUGCCCCGCGAGACUGCU | 329 | GUGCCCCGCGAGACUGCU | 329 | AGCAGUCUCGCGGGGGCAC | 1025 |
| CGUGCCCCGCGAGACUGC | 330 | CGUGCCCCGCGAGACUGC | 330 | GCAGUCUCGCGGGGGCACG | 1026 |
| UUCGCCGACCUCAUGGGGU | 331 | UUCGCCGACCUCAUGGGGU | 331 | ACCCCAUGAGGUCGGCGAA | 1027 |
| CGCCCACAGGACGUCAAGU | 332 | CGCCCACAGGACGUCAAGU | 332 | ACUUGACGUCCUGUGGGCG | 1028 |
| GCCCACAGGACGUCAAGUU | 333 | GCCCACAGGACGUCAAGUU | 333 | AACUUGACGUCCUGUGGGC | 1029 |
| ACCCCCCUCCCGGGAGAG | 334 | ACCCCCCUCCCGGGAGAG | 334 | CUCUCCCGGGAGGGGGGU | 1030 |
| GGACCCCCCUCCCGGGAG | 335 | GGACCCCCCUCCCGGGAG | 335 | CUCCCGGGAGGGGGGUCC | 1031 |
| CCGGGUCCUUUCUUGGAUC | 336 | CCGGGUCCUUUCUUGGAUC | 336 | GAUCCAAGAAAGGACCCGG | 1032 |
| CAGGACCCCCCUCCCGGG | 337 | CAGGACCCCCCUCCCGGG | 337 | CCCGGGAGGGGGGUCCUG | 1033 |
| AGGACGUCAAGUUCCCGGG | 338 | AGGACGUCAAGUUCCCGGG | 338 | CCCGGGAACUUGACGUCCU | 1034 |
| AGGACCCCCCUCCCGGGA | 339 | AGGACCCCCCUCCCGGGA | 339 | UCCCGGGAGGGGGGUCCU | 1035 |
| CCACAGGACGUCAAGUUCC | 340 | CCACAGGACGUCAAGUUCC | 340 | GGAACUUGACGUCCUGUGG | 1036 |
| CAGGACGUCAAGUUCCCGG | 341 | CAGGACGUCAAGUUCCCGG | 341 | CCGGGAACUUGACGUCCUG | 1037 |
| ACAGGACGUCAAGUUCCCG | 342 | ACAGGACGUCAAGUUCCCG | 342 | CGGGAACUUGACGUCCUGU | 1038 |
| CACAGGACGUCAAGUUCCC | 343 | CACAGGACGUCAAGUUCCC | 343 | GGGAACUUGACGUCCUGUG | 1039 |
| CAGUGGAUGAACCGGCUGA | 344 | CAGUGGAUGAACCGGCUGA | 344 | UCAGCCGGUUCAUCCACUG | 1040 |
| GGGCUCAGCCCGGGUACCC | 345 | GGGCUCAGCCCGGGUACCC | 345 | GGGUACCCGGGCUGAGCCC | 1041 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| CCGAGCGGUCGCAACCUCG | 346 | CCGAGCGGUCGCAACCUCG | 346 | CGAGGUUGCGACCGCUCGG | 1042 |
| CUGGGCUCAGCCCGGGUAC | 347 | CUGGGCUCAGCCCGGGUAC | 347 | GUACCCGGGCUGAGCCCAG | 1043 |
| AGUGGAUGAACCGGCUGAU | 348 | AGUGGAUGAACCGGCUGAU | 348 | AUCAGCCGGUUCAUCCACU | 1044 |
| UCCGAGCGGUCGCAACCUC | 349 | UCCGAGCGGUCGCAACCUC | 349 | GAGGUUGCGACCGCUCGGA | 1045 |
| UGGGCUCAGCCCGGGUACC | 350 | UGGGCUCAGCCCGGGUACC | 350 | GGUACCCGGGCUGAGCCCA | 1046 |
| GGUACCCUUGGCCCCUCUA | 351 | GGUACCCUUGGCCCCUCUA | 351 | UAGAGGGGCCAAGGGUACC | 1047 |
| UUCCGAGCGGUCGCAACCU | 352 | UUCCGAGCGGUCGCAACCU | 352 | AGGUUGCGACCGCUCGGAA | 1048 |
| GGGUACCCUUGGCCCCUCU | 353 | GGGUACCCUUGGCCCCUCU | 353 | AGAGGGGCCAAGGGUACCC | 1049 |
| GGGUCCUUUCUUGGAUCAA | 354 | GGGUCCUUUCUUGGAUCAA | 354 | UUGAUCCAAGAAAGGACCC | 1050 |
| CCCACAGGACGUCAAGUUC | 355 | CCCACAGGACGUCAAGUUC | 355 | GAACUUGACGUCCUGUGGG | 1051 |
| GGUUGCUCUUUCUCUAUCU | 356 | GGUUGCUCUUUCUCUAUCU | 356 | AGAUAGAGAAAGAGCAACC | 1052 |
| GUGGGCAGGAUGGCUCCUG | 357 | GUGGGCAGGAUGGCUCCUG | 357 | CAGGAGCCAUCCUGCCCAC | 1053 |
| GGUGGGCAGGAUGGCUCCU | 358 | GGUGGGCAGGAUGGCUCCU | 358 | AGGAGCCAUCCUGCCCACC | 1054 |
| GUUGCUCUUUCUCUAUCUU | 359 | GUUGCUCUUUCUCUAUCUU | 359 | AAGAUAGAGAAAGAGCAAC | 1055 |
| GUGGAUGAACCGGCUGAUA | 360 | GUGGAUGAACCGGCUGAUA | 360 | UAUCAGCCGGUUCAUCCAC | 1056 |
| CCAGGACCCCCCUCCCGG | 361 | CCAGGACCCCCCCUCCCGG | 361 | CCGGGAGGGGGGUCCUGG | 1057 |
| GGGUGGGCAGGAUGGCUCC | 362 | GGGUGGGCAGGAUGGCUCC | 362 | GGAGCCAUCCUGCCCACCC | 1058 |
| CUUCACGGAGGCUAUGACU | 363 | CUUCACGGAGGCUAUGACU | 363 | AGUCAUAGCCUCCGUGAAG | 1059 |
| ACCGCCGCCCACAGGACGU | 364 | ACCGCCGCCCACAGGACGU | 364 | ACGUCCUGUGGGCGGCGGU | 1060 |
| UCCAGGACCCCCCUCCCG | 365 | UCCAGGACCCCCCCUCCCG | 365 | CGGGAGGGGGGUCCUGGA | 1061 |
| AUAUGAUGAUGAACUGGUC | 366 | AUAUGAUGAUGAACUGGUC | 366 | GACCAGUUCAUCAUCAUAU | 1062 |
| UUCACGGAGGCUAUGACUA | 367 | UUCACGGAGGCUAUGACUA | 367 | UAGUCAUAGCCUCCGUGAA | 1063 |
| UCACGGAGGCUAUGACUAG | 368 | UCACGGAGGCUAUGACUAG | 368 | CUAGUCAUAGCCUCCGUGA | 1064 |
| AUGAACCGGCUGAUAGCGU | 369 | AUGAACCGGCUGAUAGCGU | 369 | ACGCUAUCAGCCGGUUCAU | 1065 |
| GGGAUAUGAUGAUGAACUG | 370 | GGGAUAUGAUGAUGAACUG | 370 | CAGUUCAUCAUCAUAUCCC | 1066 |
| UGCAGUGGAUGAACCGGCU | 371 | UGCAGUGGAUGAACCGGCU | 371 | AGCCGGUUCAUCCACUGCA | 1067 |
| GUGCAGUGGAUGAACCGGC | 372 | GUGCAGUGGAUGAACCGGC | 372 | GCCGGUUCAUCCACUGCAC | 1068 |
| UGAACCGGCUGAUAGCGUU | 373 | UGAACCGGCUGAUAGCGUU | 373 | AACGCUAUCAGCCGGUUCA | 1069 |
| GGAUAUGAUGAUGAACUGG | 374 | GGAUAUGAUGAUGAACUGG | 374 | CCAGUUCAUCAUCAUAUCC | 1070 |
| GCUCUUUCUCUAUCUUCCU | 375 | GCUCUUUCUCUAUCUUCCU | 375 | AGGAAGAUAGAGAAAGAGC | 1071 |
| GGGGGCGACACUCCACCAU | 376 | GGGGGCGACACUCCACCAU | 376 | AUGGUGGAGUGUCGCCCCC | 1072 |
| GAUGAACCGGCUGAUAGCG | 377 | GAUGAACCGGCUGAUAGCG | 377 | CGCUAUCAGCCGGUUCAUC | 1073 |
| GAUAUGAUGAUGAACUGGU | 378 | GAUAUGAUGAUGAACUGGU | 378 | ACCAGUUCAUCAUCAUAUC | 1074 |
| UGGGAUAUGAUGAUGAACU | 379 | UGGGAUAUGAUGAUGAACU | 379 | AGUUCAUCAUCAUAUCCCA | 1075 |
| UUGCUCUUUCUCUAUCUUC | 380 | UUGCUCUUUCUCUAUCUUC | 380 | GAAGAUAGAGAAAGAGCAA | 1076 |
| UGGGGGCGACACUCCACCA | 381 | UGGGGGCGACACUCCACCA | 381 | UGGUGGAGUGUCGCCCCCA | 1077 |
| UGCUCUUUCUCUAUCUUCC | 382 | UGCUCUUUCUCUAUCUUCC | 382 | GGAAGAUAGAGAAAGAGCA | 1078 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| GGUCCUUUCUUGGAUCAAC | 383 | GGUCCUUUCUUGGAUCAAC | 383 | GUUGAUCCAAGAAAGGACC | 1079 |
| AAGACUUCCGAGCGGUCGC | 384 | AAGACUUCCGAGCGGUCGC | 384 | GCGACCGCUCGGAAGUCUU | 1080 |
| AGCCCGGGUACCCUUGGCC | 385 | AGCCCGGGUACCCUUGGCC | 385 | GGCCAAGGGUACCCGGGCU | 1081 |
| UUUCUUGGAUCAACCCGCU | 386 | UUUCUUGGAUCAACCCGCU | 386 | AGCGGGUUGAUCCAAGAAA | 1082 |
| CAGCCCGGGUACCCUUGGC | 387 | CAGCCCGGGUACCCUUGGC | 387 | GCCAAGGGUACCCGGGCUG | 1083 |
| AGACUUCCGAGCGGUCGCA | 388 | AGACUUCCGAGCGGUCGCA | 388 | UGCGACCGCUCGGAAGUCU | 1084 |
| UUCUUGGAUCAACCCGCUC | 389 | UUCUUGGAUCAACCCGCUC | 389 | GAGCGGGUUGAUCCAAGAA | 1085 |
| CCCGGGUACCCUUGGCCCC | 390 | CCCGGGUACCCUUGGCCCC | 390 | GGGGCCAAGGGUACCCGGG | 1086 |
| GUCCUUUCUUGGAUCAACC | 391 | GUCCUUUCUUGGAUCAACC | 391 | GGUUGAUGCAAGAAAGGAC | 1087 |
| CUUUCUUGGAUCAACCCGC | 392 | CUUUCUUGGAUCAACCCGC | 392 | GCGGGUUGAUCCAAGAAAG | 1088 |
| CCUUUCUUGGAUCAACCCG | 393 | CCUUUCUUGGAUCAACCCG | 393 | CGGGUUGAUCCAAGAAAGG | 1089 |
| UCCUUUCUUGGAUCAACCC | 394 | UCCUUUCUUGGAUCAACCC | 394 | GGGUUGAUCCAAGAAAGGA | 1090 |
| AAGUUCCCGGGCGGUGGUC | 395 | AAGUUCCCGGGCGGUGGUC | 395 | GACCACCGCCCGGGAACUU | 1091 |
| GCAGUGGAUGAACCGGCUG | 396 | GCAGUGGAUGAACCGGCUG | 396 | CAGCCGGUUCAUCCACUGC | 1092 |
| CCGGGUACCCUUGGCCCCU | 397 | CCGGGUACCCUUGGCCCCU | 397 | AGGGGCCAAGGGUACCCGG | 1093 |
| AGUUCCCGGGCGGUGGUCA | 398 | AGUUCCCGGGCGGUGGUCA | 398 | UGACCACCGCCCGGGAACU | 1094 |
| CUUGGAUCAACCGGCUCAA | 399 | CUUGGAUCAACCGGCUCAA | 399 | UUGAGCGGGUUGAUCCAAG | 1095 |
| GGAUCAACCCGCUCAAUGC | 400 | GGAUCAACCCGCUCAAUGC | 400 | GCAUUGAGCGGGUUGAUCC | 1096 |
| ACUUCCGAGCGGUCGCAAC | 401 | ACUUCCGAGCGGUCGCAAC | 401 | GUUGCGACCGCUCGGAAGU | 1097 |
| UCUUGGAUCAACCCGCUCA | 402 | UCUUGGAUCAACCCGCUCA | 402 | UGAGCGGGUUGAUCCAAGA | 1098 |
| UUGGAUCAACCCGCUCAAU | 403 | UUGGAUCAACCCGCUCAAU | 403 | AUUGAGCGGGUUGAUCCAA | 1099 |
| AACCGCCGCCCACAGGACG | 404 | AACCGCCGCCCACAGGACG | 404 | CGUCCUGUGGGCGGCGGUU | 1100 |
| GCGUGAACUAUGCAACAGG | 405 | GCGUGAACUAUGCAACAGG | 405 | CCUGUUGCAUAGUUCACGC | 1101 |
| AUCAACCCGCUCAAUGCCU | 406 | AUCAACCCGCUCAAUGCCU | 406 | AGGCAUUGAGCGGGUUGAU | 1102 |
| GAUCAACCCGCUCAAUGCC | 407 | GAUCAACCCGCUCAAUGCC | 407 | GGCAUUGAGCGGGUUGAUC | 1103 |
| CAACCCGCUCAAUGCCUGG | 408 | CAACCCGCUCAAUGCCUGG | 408 | CCAGGCAUUGAGCGGGUUG | 1104 |
| GCUUCGCCGACCUCAUGGG | 409 | GCUUCGCCGACCUCAUGGG | 409 | CCCAUGAGGUCGGCGAAGC | 1105 |
| GACUUCCGAGCGGUCGCAA | 410 | GACUUCCGAGCGGUCGCAA | 410 | UUGCGACCGCUCGGAAGUC | 1106 |
| UCAACCCGCUCAAUGCCUG | 411 | UCAACCCGCUCAAUGCCUG | 411 | CAGGCAUUGAGCGGGUUGA | 1107 |
| GGCUUCGCCGACCUCAUGG | 412 | GGCUUCGCCGACCUCAUGG | 412 | CCAUGAGGUCGGCGAAGCC | 1108 |
| UGGAUCAACCCGCUCAAUG | 413 | UGGAUCAACCCGCUCAAUG | 413 | CAUUGAGCGGGUUGAUCCA | 1109 |
| CGGGCGGUGGUCAGAUCGU | 414 | CGGGCGGUGGUCAGAUCGU | 414 | ACGAUCUGACCACCGCCCG | 1110 |
| CUUGGCCCCUCUAUGGCAA | 415 | CUUGGCCCCUCUAUGGCAA | 415 | UUGCCAUAGAGGGGCCAAG | 1111 |
| CCGGGCGGUGGUCAGAUCG | 416 | CCGGGCGGUGGUCAGAUCG | 416 | CGAUCUGACCACCGCCCGG | 1112 |
| UGGGGUGGGCAGGAUGGCU | 417 | UGGGGUGGGCAGGAUGGCU | 417 | AGCCAUCCUGCCCACCCCA | 1113 |
| GGAGUUUACCUGUUGCCGC | 418 | GGAGUUUACCUGUUGCCGC | 418 | GCGGCAACAGGUAAACUCC | 1114 |
| CCUUGGCCCCUCUAUGGCA | 419 | CCUUGGCCCCUCUAUGGCA | 419 | UGCCAUAGAGGGGCCAAGG | 1115 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| GUGGAGUUUACCUGUUGCC | 420 | GUGGAGUUUACCUGUUGCC | 420 | GGCAACAGGUAAACUCCAC | 1116 |
| GGUGGAGUUUACCUGUUGC | 421 | GGUGGAGUUUACCUGUUGC | 421 | GCAACAGGUAAACUCCACC | 1117 |
| UUCCCGGGCGGUGGUCAGA | 422 | UUCCCGGGCGGUGGUCAGA | 422 | UCUGACCACCGCCCGGGAA | 1118 |
| UGAACUAUGCAACAGGGAA | 423 | UGAACUAUGCAACAGGGAA | 423 | UUCCCUGUUGCAUAGUUCA | 1119 |
| AGUUUACCUGUUGCCGCGC | 424 | AGUUUACCUGUUGCCGCGC | 424 | GCGCGGCAAGAGGUAAACU | 1120 |
| GUGAACUAUGCAACAGGGA | 425 | GUGAACUAUGCAACAGGGA | 425 | UCCCUGUUGCAUAGUUCAC | 1121 |
| UUACCUGUUGCCGCGCAGG | 426 | UUACCUGUUGCCGCGCAGG | 426 | CCUGCGCGGCAACAGGUAA | 1122 |
| UCCCGGGCGGUGGUCAGAU | 427 | UCCCGGGCGGUGGUCAGAU | 427 | AUCUGACCACCGCCCGGGA | 1123 |
| GUUCCCGGGCGGUGGUCAG | 428 | GUUCCCGGGCGGUGGUCAG | 428 | CUGACCACCGCCCGGGAAC | 1124 |
| GCCCGGGUACCCUUGGCCC | 429 | GCCCGGGUACCCUUGGCCC | 429 | GGGCCAAGGGUACCCGGGC | 1125 |
| AAGGAGAUGAAGGCGAAGG | 430 | AAGGAGAUGAAGGCGAAGG | 430 | CCUUCGCCUUCAUCUCCUU | 1126 |
| AGGAGAUGAAGGCGAAGGC | 431 | AGGAGAUGAAGGCGAAGGC | 431 | GCCUUCGCCUUCAUCUCCU | 1127 |
| GUUUACCUGUUGCCGCGCA | 432 | GUUUACCUGUUGCCGCGCA | 432 | UGCGCGGCAACAGGUAAAC | 1128 |
| CUGUUGCCGCGCAGGGGCC | 433 | CUGUUGCCGCGCAGGGGCC | 433 | GGCCCCUGCGCGGCAACAG | 1129 |
| AACACCAACCGCCGCCCAC | 434 | AACACCAACCGCCGCCCAC | 434 | GUGGGCGGCGGUUGGUGUU | 1130 |
| GAGUUUACCUGUUGCCGCG | 435 | GAGUUUACCUGUUGCCGCG | 435 | CGCGGCAAGAGGUAAACUC | 1131 |
| UUUACCUGUUGCCGCGCAG | 436 | UUUACCUGUUGCCGCGCAG | 436 | CUGCGCGGCAACAGGUAAA | 1132 |
| GGGGUGGGCAGGAUGGCUC | 437 | GGGGUGGGCAGGAUGGCUC | 437 | GAGCCAUCCUGCCCACCCC | 1133 |
| GAAGACUUCCGAGCGGUCG | 438 | GAAGACUUCCGAGCGGUCG | 438 | CGACCGCUCGGAAGUCUUC | 1134 |
| ACCUGUUGCCGCGCAGGGG | 439 | ACCUGUUGCCGCGCAGGGG | 439 | CCCCUGCGCGGCAACAGGU | 1135 |
| UACCUGUUGCCGCGCAGGG | 440 | UACCUGUUGCCGCGCAGGG | 440 | CCCUGCGCGGCAACAGGUA | 1136 |
| UACCUCUUCAACUGGGCAG | 441 | UACCUCUUCAACUGGGCAG | 441 | CUGCCCAGUUGAAGAGGUA | 1137 |
| CGUGAACUAUGCAACAGGG | 442 | CGUGAACUAUGCAACAGGG | 442 | CCCUGUUGCAUAGUUCACG | 1138 |
| ACACCAACCGCCGCCCACA | 443 | ACACCAACCGCCGCCCACA | 443 | UGUGGGCGGCGGUUGGUGU | 1139 |
| CCCGGGCGGUGGUCAGAUC | 444 | CCCGGGCGGUGGUCAGAUC | 444 | GAUCUGACCACCGCCCGGG | 1140 |
| ACCUCUUCAACUGGGCAGU | 445 | ACCUCUUCAACUGGGCAGU | 445 | ACUGCCCAGUUGAAGAGGU | 1141 |
| CUUCGCCGACCUCAUGGGG | 446 | CUUCGCCGACCUCAUGGGG | 446 | CCCCAUGAGGUCGGCGAAG | 1142 |
| CCUGUUGCCGCGCAGGGGC | 447 | CCUGUUGCCGCGCAGGGGC | 447 | GCCCCUGCGCGGCAACAGG | 1143 |
| CCAACCGCCGCCCACAGGA | 448 | CCAACCGCCGCCCACAGGA | 448 | UCCUGUGGGCGGCGGUUGG | 1144 |
| ACCAACCGCCGCCCACAGG | 449 | ACCAACCGCCGCCCACAGG | 449 | CCUGUGGGCGGCGGUUGGU | 1145 |
| UGGAGUUUACCUGUUGCCG | 450 | UGGAGUUUACCUGUUGCCG | 450 | CGGCAACAGGUAAACUCCA | 1146 |
| CACCAACCGCCGCCCACAG | 451 | CACCAACCGCCGCCCACAG | 451 | CUGUGGGCGGCGGUUGGUG | 1147 |
| CAAACGUAACACCAACCGC | 452 | CAAACGUAACACCAACCGC | 452 | GCGGUUGGUGUUACGUUUG | 1148 |
| CAAGCGGAGACGGCUGGAG | 453 | CAAGCGGAGACGGCUGGAG | 453 | CUCCAGCCGUCUCCGCUUG | 1149 |
| ACGGAGGCUAUGACUAGGU | 454 | ACGGAGGCUAUGACUAGGU | 454 | ACCUAGUCAUAGCCUCCGU | 1150 |
| UAACACCAACCGCCGCCCA | 455 | UAACACCAACCGCCGCCCA | 455 | UGGGCGGCGGUUGGUGUUA | 1151 |
| AUCGUUGGUGGAGUUUACC | 456 | AUCGUUGGUGGAGUUUACC | 456 | GGUAAACUCCACCAACGAU | 1152 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| GGGAGACAUAUAUCACAGC | 457 | GGGAGACAUAUAUCACAGC | 457 | GCUGUGAUAUAUGUCUCCC | 1153 |
| AACCUCGUGGAAGGCGACA | 458 | AACCUCGUGGAAGGCGACA | 458 | UGUCGCCUUCCACGAGGUU | 1154 |
| GGGGGAGACAUAUAUCACA | 459 | GGGGGAGACAUAUAUCACA | 459 | UGUGAUAUAUGUCUCCCCC | 1155 |
| AACGUAACACCAACCGCCG | 460 | AACGUAACACCAACCGCCG | 460 | GGGCGGUUGGUGUUACGUU | 1156 |
| AAACGUAACACCAACCGCC | 461 | AAACGUAACACCAACCGCC | 461 | GGCGGUUGGUGUUACGUUU | 1157 |
| GGGGAGACAUAUAUCACAG | 462 | GGGGAGACAUAUAUCACAG | 462 | CUGUGAUAUAUGUCUCCCC | 1158 |
| GAGAUGAAGGCGAAGGCGU | 463 | GAGAUGAAGGCGAAGGCGU | 463 | ACGCCUUCGCCUUCAUCUC | 1159 |
| AAGCGGAGACGGCUGGAGC | 464 | AAGCGGAGACGGCUGGAGC | 464 | GCUCCAGCCGUCUCCGCUU | 1160 |
| GUACCCUUGGCCCCUCUAU | 465 | GUACCCUUGGCCCCUCUAU | 465 | AUAGAGGGGCCAAGGGUAC | 1161 |
| CCUCCAGGACCCCCCCUCC | 466 | CCUCCAGGACCCCCCCUCC | 466 | GGAGGGGGGUCCUGGAGG | 1162 |
| CUCCAGGACCCCCCCUCCC | 467 | CUCCAGGACCCCCCCUCCC | 467 | GGGAGGGGGGUCCUGGAG | 1163 |
| UACCCUUGGCCCCUCUAUG | 468 | UACCCUUGGCCCCUCUAUG | 468 | CAUAGAGGGGCCAAGGGUA | 1164 |
| CAACCUCGUGGAAGGCGAC | 469 | CAACCUCGUGGAAGGCGAC | 469 | GUCGCCUUCCACGAGGUUG | 1165 |
| CGGAGGCUAUGACUAGGUA | 470 | CGGAGGCUAUGACUAGGUA | 470 | UACCUAGUCAUAGCCUCCG | 1166 |
| GGAGAUGAAGGCGAAGGCG | 471 | GGAGAUGAAGGCGAAGGCG | 471 | CGCCUUCGCCUUCAUCUCC | 1167 |
| AGAUGAAGGCGAAGGCGUC | 472 | AGAUGAAGGCGAAGGCGUC | 472 | GACGCCUUCGCCUUCAUCU | 1168 |
| GUAACACCAACCGCCGCCC | 473 | GUAACACCAACCGCCGCCC | 473 | GGGCGGCGGUUGGUGUUAC | 1169 |
| CGUAACACCAACCGCCGCC | 474 | CGUAACACCAACCGCCGCC | 474 | GGCGGCGGUUGGUGUUACG | 1170 |
| ACGUAACACCAACCGCCGC | 475 | ACGUAACACCAACCGCCGC | 475 | GCGGCGGUUGGUGUUACGU | 1171 |
| CACGGAGGCUAUGACUAGG | 476 | CACGGAGGCUAUGACUAGG | 476 | CCUAGUCAUAGCCUCCGUG | 1172 |
| GUUGGUGGAGUUUACCUGU | 477 | GUUGGUGGAGUUUACCUGU | 477 | ACAGGUAAACUCCACCAAC | 1173 |
| CGUUGGUGGAGUUUACCUG | 478 | CGUUGGUGGAGUUUACCUG | 478 | CAGGUAAACUCCACCAACG | 1174 |
| ACCCUUGGCCCCUCUAUGG | 479 | ACCCUUGGCCCCUCUAUGG | 479 | CCAUAGAGGGGCCAAGGGU | 1175 |
| UUGGUGGAGUUUACCUGUU | 480 | UUGGUGGAGUUUACCUGUU | 480 | AACAGGUAAACUCCACCAA | 1176 |
| UGGUGGAGUUUACCUGUUG | 481 | UGGUGGAGUUUACCUGUUG | 481 | CAACAGGUAAACUCCACCA | 1177 |
| UCGUUGGUGGAGUUUACCU | 482 | UCGUUGGUGGAGUUUACCU | 482 | AGGUAAACUCCACCAACGA | 1178 |
| CGGGUACCCUUGGCCCCUC | 483 | CGGGUACCCUUGGCCCCUC | 483 | GAGGGGCCAAGGGUACCCG | 1179 |
| GGCUCAGCCCGGGUACCCU | 484 | GGCUCAGCCCGGGUACCCU | 484 | AGGGUACCCGGGCUGAGCC | 1180 |
| GAUCACUCCCCUGUGAGGA | 485 | GAUCACUCCCCUGUGAGGA | 485 | UCCUCACAGGGGAGUGAUC | 1181 |
| GGUGGUCAGAUCGUUGGUG | 486 | GGUGGUCAGAUCGUUGGUG | 486 | CACCAACGAUCUGACCACC | 1182 |
| GAUGAAGGCGAAGGCGUCC | 487 | GAUGAAGGCGAAGGCGUCC | 487 | GGACGCCUUCGCCUUCAUC | 1183 |
| AGGAUGGCUCCUGUCACCC | 488 | AGGAUGGCUCCUGUCACCC | 488 | GGGUGACAGGAGCCAUCCU | 1184 |
| CUCAGCCCGGGUACCCUUG | 489 | CUCAGCCCGGGUACCCUUG | 489 | CAAGGGUACCCGGGCUGAG | 1185 |
| UCAGCCCGGGUACCCUUGG | 490 | UCAGCCCGGGUACCCUUGG | 490 | CCAAGGGUACCCGGGCUGA | 1186 |
| AUGAAGGCGAAGGCGUCCA | 491 | AUGAAGGCGAAGGCGUCCA | 491 | UGGACGCCUUCGCCUUCAU | 1187 |
| CGGGGGAGACAUAUAUCAC | 492 | CGGGGGAGACAUAUAUCAC | 492 | GUGAUAUAUGUCUCCCCCG | 1188 |
| CAGGAUGGCUCCUGUCACC | 493 | CAGGAUGGCUCCUGUCACC | 493 | GGUGACAGGAGCCAUCCUG | 1189 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| UGAAGGCGAAGGCGUCCAC | 494 | UGAAGGCGAAGGCGUCCAC | 494 | GUGGACGCCUUCGCCUUCA | 1190 |
| UGGUCAGAUCGUUGGUGGA | 495 | UGGUCAGAUCGUUGGUGGA | 495 | UCCACCAACGAUCUGACCA | 1191 |
| GCUCAGCCCGGGUACCCUU | 496 | GCUCAGCCCGGGUACCCUU | 496 | AAGGGUACCCGGGCUGAGC | 1192 |
| GUGGUCAGAUCGUUGGUGG | 497 | GUGGUCAGAUCGUUGGUGG | 497 | CCACCAACGAUCUGACCAC | 1193 |
| CAGCCUCCAGGACCCCCCC | 498 | CAGCCUCCAGGACCCCCCC | 498 | GGGGGGGUCCUGGAGGCUG | 1194 |
| GGCGGUGGUCAGAUCGUUG | 499 | GGCGGUGGUCAGAUCGUUG | 499 | CAACGAUCUGACCACCGCC | 1195 |
| GCCUCCAGGACCCCCCCUC | 500 | GCCUCCAGGACCCCCCCUC | 500 | GAGGGGGGUCCUGGAGGC | 1196 |
| AACCGGCUGAUAGCGUUCG | 501 | AACCGGCUGAUAGCGUUCG | 501 | CGAACGCUAUCAGCCGGUU | 1197 |
| AGCCUCCAGGACCCCCCCU | 502 | AGCCUCCAGGACCCCCCCU | 502 | AGGGGGGGUCCUGGAGGCU | 1198 |
| CGGCUUCGCCGACCUCAUG | 503 | CGGCUUCGCCGACCUCAUG | 503 | CAUGAGGUCGGCGAAGCCG | 1199 |
| GCGGAGACGGCUGGAGCGC | 504 | GCGGAGACGGCUGGAGCGC | 504 | GCGCUCCAGCCGUCUCCGC | 1200 |
| UCAUGGGGUACAUUCCGCU | 505 | UCAUGGGGUACAUUCCGCU | 505 | AGCGGAAUGUACCCCAUGA | 1201 |
| GAACCGGCUGAUAGCGUUC | 506 | GAACCGGCUGAUAGCGUUC | 506 | GAACGCUAUCAGCCGGUUC | 1202 |
| GCGGUGGUCAGAUCGUUGG | 507 | GCGGUGGUCAGAUCGUUGG | 507 | CCAACGAUCUGACCACCGC | 1203 |
| GGCAGGAUGGCUCCUGUCA | 508 | GGCAGGAUGGCUCCUGUCA | 508 | UGACAGGAGCCAUCCUGCC | 1204 |
| GCAGGAUGGCUCCUGUCAC | 509 | GCAGGAUGGCUCCUGUCAC | 509 | GUGACAGGAGCCAUCCUGC | 1205 |
| AUUUGGGUAAGGUCAUCGA | 510 | AUUUGGGUAAGGUCAUCGA | 510 | UCGAUGACCUUACCCAAAU | 1206 |
| ACCGGCUGAUAGCGUUCGC | 511 | ACCGGCUGAUAGCGUUCGC | 511 | GCGAACGCUAUCAGCCGGU | 1207 |
| CGGAGACGGCUGGAGCGCG | 512 | CGGAGACGGCUGGAGCGCG | 512 | CGCGCUCCAGCCGUCUCCG | 1208 |
| GCGGCUUCGCCGACCUCAU | 513 | GCGGCUUCGCCGACCUCAU | 513 | AUGAGGUCGGCGAAGCCGC | 1209 |
| AAUUUGGGUAAGGUCAUCG | 514 | AAUUUGGGUAAGGUCAUCG | 514 | CGAUGACCUUACCCAAAUU | 1210 |
| GGGCGGUGGUCAGAUCGUU | 515 | GGGCGGUGGUCAGAUCGUU | 515 | AACGAUCUGACCACCGCCC | 1211 |
| CAACCGCCGCCCACAGGAC | 516 | CAACCGCCGCCCACAGGAC | 516 | GUCCUGUGGGCGGCGGUUG | 1212 |
| UGCGGCUUCGCCGACCUCA | 517 | UGCGGCUUCGCCGACCUCA | 517 | UGAGGUCGGCGAAGCCGCA | 1213 |
| CGGUGGUCAGAUCGUUGGU | 518 | CGGUGGUCAGAUCGUUGGU | 518 | ACCAACGAUCUGACCACCG | 1214 |
| UUGGGUGUGCGCGCGACUA | 519 | UUGGGUGUGCGCGCGACUA | 519 | UAGUCGCGCGCACACCCAA | 1215 |
| GUGUGCGCGCGACUAGGAA | 520 | GUGUGCGCGCGACUAGGAA | 520 | UUCCUAGUCGCGCGGACAC | 1216 |
| GAUGGCUCCUGUCACCCCG | 521 | GAUGGCUCCUGUCACCCCG | 521 | CGGGGUGACAGGAGCCAUC | 1217 |
| GGAUGGCUCCUGUCACCCC | 522 | GGAUGGCUCCUGUCACCCC | 522 | GGGGUGACAGGAGCCAUCC | 1218 |
| UGUGCGCGCGACUAGGAAG | 523 | UGUGCGCGCGACUAGGAAG | 523 | CUUCCUAGUCGCGCGCACA | 1219 |
| UGGGUGUGCGCGCGACUAG | 524 | UGGGUGUGCGCGCGACUAG | 524 | CUAGUCGCGCGCACACCCA | 1220 |
| GGUGUGCGCGCGACUAGGA | 525 | GGUGUGCGCGCGACUAGGA | 525 | UCCUAGUCGCGCGCACACC | 1221 |
| GGGUGUGCGCGCGACUAGG | 526 | GGGUGUGCGCGCGACUAGG | 526 | CCUAGUCGCGCGCACACCC | 1222 |
| CCCCGGCGUAGGUCGCGUA | 527 | CCCCGGCGUAGGUCGCGUA | 527 | UACGCGACCUACGCCGGGG | 1223 |
| GAAGGCGACAACCUAUCCC | 528 | GAAGGCGACAACCUAUCCC | 528 | GGGAUAGGUUGUCGCCUUC | 1224 |
| CCCGGCGUAGGUCGCGUAA | 529 | CCCGGCGUAGGUCGCGUAA | 529 | UUACGCGACCUACGCCGGG | 1225 |
| AGCGGAGACGGCUGGAGCG | 530 | AGCGGAGACGGCUGGAGCG | 530 | CGCUCCAGCCGUCUCCGCU | 1226 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| CCCCCGGCGUAGGUCGCGU | 531 | CCCCCGGCGUAGGUCGCGU | 531 | ACGCGACCUACGCCGGGGG | 1227 |
| AGGCGAAGGCGUCCACAGU | 532 | AGGCGAAGGCGUCCACAGU | 532 | ACUGUGGACGCCUUCGCCU | 1228 |
| AAGGCGAAGGCGUCCACAG | 533 | AAGGCGAAGGCGUCCACAG | 533 | CUGUGGACGCCUUCGCCUU | 1229 |
| GUUGGGUGUGCGCGCGACU | 534 | GUUGGGUGUGCGCGCGACU | 534 | AGUCGCGCGCACACCCAAC | 1230 |
| CUCAUGGGGUACAUUCCGC | 535 | CUCAUGGGGUACAUUCCGC | 535 | GCGGAAUGUACCCCAUGAG | 1231 |
| GGAAGGCGACAACCUAUCC | 536 | GGAAGGCGACAACCUAUCC | 536 | GGAUAGGUUGUCGCCUUCC | 1232 |
| GCAAGUUCCUUGCCGACGG | 537 | GCAAGUUCCUUGCCGACGG | 537 | CCGUCGGCAAGGAACUUGC | 1233 |
| UGCAGCCUCCAGGACCCCC | 538 | UGCAGCCUCCAGGACCCCC | 538 | GGGGGUCCUGGAGGCUGCA | 1234 |
| GGACUGCACGAUGCUCGUG | 539 | GGACUGCACGAUGCUCGUG | 539 | CACGAGCAUCGUGCAGUCC | 1235 |
| GAAGGCGAAGGCGUCCACA | 540 | GAAGGCGAAGGCGUCCACA | 540 | UGUGGACGCCUUCGCCUUC | 1236 |
| GCAACCUCGUGGAAGGCGA | 541 | GCAACCUCGUGGAAGGCGA | 541 | UCGCCUUCCACGAGGUUGC | 1237 |
| GACGCGGGCUGUGCUUGGU | 542 | GACGCGGGCUGUGCUUGGU | 542 | ACCAAGCACAGCCCGCGUC | 1238 |
| ACGCGGGCUGUGCUUGGUA | 543 | ACGCGGGCUGUGCUUGGUA | 543 | UACCAAGCACAGCCCGCGU | 1239 |
| GUGCAGCCUCCAGGACCCC | 544 | GUGCAGCCUCCAGGACCCC | 544 | GGGGUCCUGGAGGCUGCAC | 1240 |
| GCAGCCUCCAGGACCCCCC | 545 | GCAGCCUCCAGGACCCCCC | 545 | GGGGGGUCCUGGAGGCUGC | 1241 |
| CGCAACCUCGUGGAAGGCG | 546 | CGCAACCUCGUGGAAGGCG | 546 | CGCCUUCCACGAGGUUGCG | 1242 |
| UGUCGUGCAGCCUCCAGGA | 547 | UGUCGUGCAGCCUCCAGGA | 547 | UCCUGGAGGCUGCACGACA | 1243 |
| AUGGCUUGGGAUAUGAUGA | 548 | AUGGCUUGGGAUAUGAUGA | 548 | UCAUCAUAUCCCAAGCCAU | 1244 |
| CUUGGGAUAUGAUGAUGAA | 549 | CUUGGGAUAUGAUGAUGAA | 549 | UUCAUCAUCAUAUCCCAAG | 1245 |
| CCCUUGGCCCCUCUAUGGC | 550 | CCCUUGGCCCCUCUAUGGC | 550 | GCCAUAGAGGGGCCAAGGG | 1246 |
| UGGCUUGGGAUAUGAUGAU | 551 | UGGCUUGGGAUAUGAUGAU | 551 | AUCAUCAUAUCCCAAGCCA | 1247 |
| CUGUGCAGUGGAUGAACCG | 552 | CUGUGCAGUGGAUGAACCG | 552 | CGGUUCAUCCACUGCACAG | 1248 |
| AUGACGCGGGCUGUGCUUG | 553 | AUGACGCGGGCUGUGCUUG | 553 | CAAGCACAGCCCGCGUCAU | 1249 |
| GCUUGGGAUAUGAUGAUGA | 554 | GCUUGGGAUAUGAUGAUGA | 554 | UCAUCAUCAUAUCCCAAGC | 1250 |
| UAUGACGCGGGCUGUGCUU | 555 | UAUGACGCGGGCUGUGCUU | 555 | AAGCACAGCCCGCGUCAUA | 1251 |
| UGACGCGGGCUGUGCUUGG | 556 | UGACGCGGGCUGUGCUUGG | 556 | CCAAGCACAGCCCGCGUCA | 1252 |
| GGCUUGGGAUAUGAUGAUG | 557 | GGCUUGGGAUAUGAUGAUG | 557 | CAUCAUCAUAUCCCAAGCC | 1253 |
| UGUGCAGUGGAUGAACCGG | 558 | UGUGCAGUGGAUGAACCGG | 558 | CCGGUUCAUCCACUGCACA | 1254 |
| GCUGUGCAGUGGAUGAACC | 559 | GCUGUGCAGUGGAUGAACC | 559 | GGUUCAUCCACUGCACAGC | 1255 |
| CUCUUCAACUGGGCAGUAA | 560 | CUCUUCAACUGGGCAGUAA | 560 | UUACUGGCCAGUUGAAGAG | 1256 |
| CCUCGUGGAAGGCGACAAC | 561 | CCUCGUGGAAGGCGACAAC | 561 | GUUGUCGCCUUCCACGAGG | 1257 |
| UGUGUCACCCAGACAGUCG | 562 | UGUGUCACCCAGACAGUCG | 562 | CGACUGUCUGGGUGACACA | 1258 |
| GGCGUGAACUAUGCAACAG | 563 | GGCGUGAACUAUGCAACAG | 563 | CUGUUGCAUAGUUCACGCC | 1259 |
| CGGCGUGAACUAUGCAACA | 564 | CGGCGUGAACUAUGCAACA | 564 | UGUUGCAUAGUUCACGCCG | 1260 |
| GUGUCACCCAGACAGUCGA | 565 | GUGUCACCCAGACAGUCGA | 565 | UCGACUGUCUGGGUGACAC | 1261 |
| CCUCUUCAACUGGGCAGUA | 566 | CCUCUUCAACUGGGCAGUA | 566 | UACUGCCCAGUUGAAGAGG | 1262 |
| CGUGGAAGGCGACAACCUA | 567 | CGUGGAAGGCGACAACCUA | 567 | UAGGUUGUCGCCUUCCACG | 1263 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| UCGUGGAAGGCGACAACCU | 568 | UCGUGGAAGGCGACAACCU | 568 | AGGUUGUCGCCUUCCACGA | 1264 |
| CGGCCUAGUUGGGGCCCCA | 569 | CGGCCUAGUUGGGGCCCCA | 569 | UGGGGCCCCAACUAGGCCG | 1265 |
| CGACUAGGAAGACUUCCGA | 570 | CGACUAGGAAGACUUCCGA | 570 | UCGGAAGUCUUCCUAGUCG | 1266 |
| UUUGGGUAAGGUCAUCGAU | 571 | UUUGGGUAAGGUCAUCGAU | 571 | AUCGAUGACCUUACCCAAA | 1267 |
| GUGGAAGGCGACAACCUAU | 572 | GUGGAAGGCGACAACCUAU | 572 | AUAGGUUGUCGCCUUCCAC | 1268 |
| ACCUCGUGGAAGGCGACAA | 573 | ACCUCGUGGAAGGCGACAA | 573 | UUGUCGCCUUCCACGAGGU | 1269 |
| GCGACUAGGAAGACUUCCG | 574 | GCGACUAGGAAGACUUCCG | 574 | CGGAAGUCUUCCUAGUCGC | 1270 |
| GUCGUGCAGCCUCCAGGAC | 575 | GUCGUGCAGCCUCCAGGAC | 575 | GUCCUGGAGGCUGCACGAC | 1271 |
| UAGGAAGACUUCCGAGCGG | 576 | UAGGAAGACUUCCGAGCGG | 576 | CCGCUCGGAAGUCUUCCUA | 1272 |
| ACGGCGUGAACUAUGCAAC | 577 | ACGGCGUGAACUAUGCAAC | 577 | GUUGCAUAGUUCACGCCGU | 1273 |
| CUCGUGGAAGGCGACAACC | 578 | CUCGUGGAAGGCGACAACC | 578 | GGUUGUCGCCUUCCACGAG | 1274 |
| GGUCGCAACCUCGUGGAAG | 579 | GGUCGCAACCUCGUGGAAG | 579 | CUUCCACGAGGUUGCGACC | 1275 |
| CGGUCGCAACCUCGUGGAA | 580 | CGGUCGCAACCUCGUGGAA | 580 | UUCCACGAGGUUGCGACCG | 1276 |
| GCGCGCGACUAGGAAGACU | 581 | GCGCGCGACUAGGAAGACU | 581 | AGUCUUCCUAGUCGCGCGC | 1277 |
| GACGGCGUGAACUAUGCAA | 582 | GACGGCGUGAACUAUGCAA | 582 | UUGCAUAGUUCACGCCGUC | 1278 |
| UAGAUCACUCCCCUGUGAG | 583 | UAGAUCACUCCCCUGUGAG | 583 | CUCACAGGGGAGUGAUCUA | 1279 |
| AGCGGUCGCAACCUCGUGG | 584 | AGCGGUCGCAACCUCGUGG | 584 | CCACGAGGUUGCGACCGCU | 1280 |
| UGGAAGGCGACAACCUAUC | 585 | UGGAAGGCGACAACCUAUC | 585 | GAUAGGUUGUCGCCUUCCA | 1281 |
| CGCGCGACUAGGAAGACUU | 586 | CGCGCGACUAGGAAGACUU | 586 | AAGUCUUCCUAGUCGCGCG | 1282 |
| CUAGGAAGACUUCCGAGCG | 587 | CUAGGAAGACUUCCGAGCG | 587 | CGCUCGGAAGUCUUCCUAG | 1283 |
| GUGCGCGCGACUAGGAAGA | 588 | GUGCGCGCGACUAGGAAGA | 588 | UCUUCCUAGUCGCGCGCAC | 1284 |
| AGAUCACUCCCCUGUGAGG | 589 | AGAUCACUCCCCUGUGAGG | 589 | CCUCACAGGGGAGUGAUCU | 1285 |
| UGCGCGCGACUAGGAAGAC | 590 | UGCGCGCGACUAGGAAGAC | 590 | GUCUUCCUAGUCGCGCGCA | 1286 |
| AUAGAUCACUCCCCUGUGA | 591 | AUAGAUCACUCCCCUGUGA | 591 | UCACAGGGGAGUGAUCUAU | 1287 |
| GAGCGGUCGCAACCUCGUG | 592 | GAGCGGUCGCAACCUCGUG | 592 | CACGAGGUUGCGACCGCUC | 1288 |
| CACGAACGACUGCUCCAAC | 593 | CACGAACGACUGCUCCAAC | 593 | GUUGGAGCAGUCGUUCGUG | 1289 |
| GGCAAGUUCCUUGCCGACG | 594 | GGCAAGUUCCUUGCCGACG | 594 | CGUCGGCAAGGAACUUGCC | 1290 |
| UCGUGCAGCCUCCAGGACC | 595 | UCGUGCAGCCUCCAGGACC | 595 | GGUCCUGGAGGCUGCACGA | 1291 |
| GUCACGAACGACUGCUCCA | 596 | GUCACGAACGACUGCUCCA | 596 | UGGAGCAGUCGUUCGUGAC | 1292 |
| GCGGUCGCAACCUCGUGGA | 597 | GCGGUCGCAACCUCGUGGA | 597 | UCCACGAGGUUGCGACCGC | 1293 |
| GCGCGACUAGGAAGACUUC | 598 | GCGCGACUAGGAAGACUUC | 598 | GAAGUCUUCCUAGUCGCGC | 1294 |
| GCUAUGACGCGGGCUGUGC | 599 | GCUAUGACGCGGGCUGUGC | 599 | GCACAGCCCGCGUCAUAGC | 1295 |
| UCACGAACGACUGCUCCAA | 600 | UCACGAACGACUGCUCCAA | 600 | UUGGAGCAGUCGUUCGUGA | 1296 |
| UCGCAACCUCGUGGAAGGC | 601 | UCGCAACCUCGUGGAAGGC | 601 | GCCUUCCACGAGGUUGCGA | 1297 |
| CGUGCAGCCUCCAGGACCC | 602 | CGUGCAGCCUCCAGGACCC | 602 | GGGUCCUGGAGGCUGCACG | 1298 |
| GUCGCAACCUCGUGGAAGG | 603 | GUCGCAACCUCGUGGAAGG | 603 | CCUUCCACGAGGUUGCGAC | 1299 |
| ACUAGGAAGACUUCCGAGC | 604 | ACUAGGAAGACUUCCGAGC | 604 | GCUCGGAAGUCUUCCUAGU | 1300 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| CGCGACUAGGAAGACUUCC | 605 | CGCGACUAGGAAGACUUCC | 605 | GGAAGUCUUCCUAGUCGCG | 1301 |
| UGGGCGAAGCACAUGUGGA | 606 | UGGGCGAAGCACAUGUGGA | 606 | UCCACAUGUGCUUCGCCCA | 1302 |
| CCUUGCCUACUAUUCCAUG | 607 | CCUUGCCUACUAUUCCAUG | 607 | CAUGGAAUAGUAGGCAAGG | 1303 |
| GCCUCAGGAAACUUGGGGU | 608 | GCCUCAGGAAACUUGGGGU | 608 | ACCCCAAGUUUCCUGAGGC | 1304 |
| UGCUAUGACGCGGGCUGUG | 609 | UGCUAUGACGCGGGCUGUG | 609 | CACAGCCCGCGUCAUAGCA | 1305 |
| UCGUGCUCGCCACCGCUAC | 610 | UCGUGCUCGCCACCGCUAC | 610 | GUAGCGGUGGCGAGCACGA | 1306 |
| UGCCUCAGGAAACUUGGGG | 611 | UGCCUCAGGAAACUUGGGG | 611 | CCCCAAGUUUCCUGAGGCA | 1307 |
| UGUCUCGUGCCCGACCCCG | 612 | UGUCUCGUGCCCGACCCCG | 612 | CGGGGUCGGGCACGAGACA | 1308 |
| UGUGGCGGCAGGAGAUGGG | 613 | UGUGGCGGCAGGAGAUGGG | 613 | CCCAUCUCCUGCCGCCACA | 1309 |
| GUCGUGCUCGCCACCGCUA | 614 | GUCGUGCUCGCCACCGCUA | 614 | UAGCGGUGGCGAGCACGAC | 1310 |
| GAUUUCCACUACGUGACGG | 615 | GAUUUCCACUACGUGACGG | 615 | CCGUCACGUAGUGGAAAUC | 1311 |
| GGGCCUUGCCUACUAUUCC | 616 | GGGCCUUGCCUACUAUUCC | 616 | GGAAUAGUAGGCAAGGCCC | 1312 |
| GCCUUGCCUACUAUUCCAU | 617 | GCCUUGCCUACUAUUCCAU | 617 | AUGGAAUAGUAGGCAAGGC | 1313 |
| GACUAGGAAGACUUCCGAG | 618 | GACUAGGAAGACUUCCGAG | 618 | CUCGGAAGUCUUCCUAGUC | 1314 |
| GCGGGGAGACAUAUAUCA | 619 | GCGGGGAGACAUAUAUCA | 619 | UGAUAUAUGUCUCCCCGC | 1315 |
| CGAGCGGUCGCAACCUCGU | 620 | CGAGCGGUCGCAACCUCGU | 620 | ACGAGGUUGCGACCGCUCG | 1316 |
| GGCCUUGCCUACUAUUCCA | 621 | GGCCUUGCCUACUAUUCCA | 621 | UGGAAUAGUAGGCAAGGCC | 1317 |
| AUUUCCACUACGUGACGGG | 622 | AUUUCCACUACGUGACGGG | 622 | CCCGUCACGUAGUGGAAAU | 1318 |
| GGACGUCAAGUUCCCGGGC | 623 | GGACGUCAAGUUCCCGGGC | 623 | GCCCGGGAACUUGACGUCC | 1319 |
| GAGUGCUAUGACGCGGGCU | 624 | GAGUGCUAUGACGCGGGCU | 624 | AGCCCGCGUCAUAGCACUC | 1320 |
| GACGUCAAGUUCCCGGGCG | 625 | GACGUCAAGUUCCCGGGCG | 625 | CGCCCGGGAACUUGACGUC | 1321 |
| UCAGCGACGGGUCUUGGUC | 626 | UCAGCGACGGGUCUUGGUC | 626 | GACCAAGACCCGUCGCUGA | 1322 |
| UCAAGUUCCCGGGCGGUGG | 627 | UCAAGUUCCCGGGCGGUGG | 627 | CCACCGCCCGGGAACUUGA | 1323 |
| UCAAGGAGAUGAAGGCGAA | 628 | UCAAGGAGAUGAAGGCGAA | 628 | UUCGCCUUCAUCUCCUUGA | 1324 |
| CCUAUCCCCAAGGCUCGCC | 629 | CCUAUCCCCAAGGCUCGCC | 629 | GGCGAGCCUUGGGGAUAGG | 1325 |
| CUUGACCUACCUCAGAUCA | 630 | CUUGACCUACCUCAGAUCA | 630 | UGAUCUGAGGUAGGUCAAG | 1326 |
| UUUCCACUACGUGACGGGC | 631 | UUUCCACUACGUGACGGGC | 631 | GCCCGUCACGUAGUGGAAA | 1327 |
| AGUGCUAUGACGCGGGCUG | 632 | AGUGCUAUGACGCGGGCUG | 632 | CAGCCCGCGUCAUAGCACU | 1328 |
| ACGUCAAGUUCCCGGGCGG | 633 | ACGUCAAGUUCCCGGGCGG | 633 | CCGCCCGGGAACUUGACGU | 1329 |
| UCUGGAGACAUCGGGCCAG | 634 | UCUGGAGACAUCGGGCCAG | 634 | CUGGCCCGAUGUCUCCAGA | 1330 |
| GGGCGAAGCACAUGUGGAA | 635 | GGGCGAAGCACAUGUGGAA | 635 | UUCCACAUGUGCUUCGCCC | 1331 |
| UUGACCUACCUCAGAUCAU | 636 | UUGACCUACCUCAGAUCAU | 636 | AUGAUCUGAGGUAGGUCAA | 1332 |
| CCAAGCGGAGACGGCUGGA | 637 | CCAAGCGGAGACGGCUGGA | 637 | UCCAGCCGUCUCCGCUUGG | 1333 |
| ACCAAGCGGAGACGGCUGG | 638 | ACCAAGCGGAGACGGCUGG | 638 | CCAGCCGUCUCCGCUUGGU | 1334 |
| GGGUGGCUUCAUGCCUCAG | 639 | GGGUGGCUUCAUGCCUCAG | 639 | CUGAGGCAUGAAGCCACCC | 1335 |
| GUCAAGUUCCCGGGCGGUG | 640 | GUCAAGUUCCCGGGCGGUG | 640 | CACCGCCCGGGAACUUGAC | 1336 |
| CUCAAGGAGAUGAAGGCGA | 641 | CUCAAGGAGAUGAAGGCGA | 641 | UCGCCUUCAUCUCCUUGAG | 1337 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| GACCAAGCGGAGACGGCUG | 642 | GACCAAGCGGAGACGGCUG | 642 | CAGCCGUCUCCGCUUGGUC | 1338 |
| UCCAGGUCGGGCUCAACCA | 643 | UCCAGGUCGGGCUCAACCA | 643 | UGGUUGAGCCCGACCUGGA | 1339 |
| CUCUUUCUCUAUCUUCCUC | 644 | CUCUUUCUCUAUCUUCCUC | 644 | GAGGAAGAUAGAGAAAGAG | 1340 |
| GUCUGGAGACAUCGGGCCA | 645 | GUCUGGAGACAUCGGGCCA | 645 | UGGCCCGAUGUCUCCAGAC | 1341 |
| GUUGUGACUUGGCCCCCGA | 646 | GUUGUGACUUGGCCCCCGA | 646 | UCGGGGGCCAAGUCACAAC | 1342 |
| AGACCUGGCUCCAGUCCAA | 647 | AGACCUGGCUCCAGUCCAA | 647 | UUGGACUGGAGCCAGGUCU | 1343 |
| CUUGCCUACUAUUCCAUGG | 648 | CUUGCCUACUAUUCCAUGG | 648 | CCAUGGAAUAGUAGGCAAG | 1344 |
| CCCGGUUGCUCUUUCUCUA | 649 | CCCGGUUGCUCUUUCUCUA | 649 | UAGAGAAAGAGCAACCGGG | 1345 |
| CUUUCUCUAUCUUCCUCUU | 650 | CUUUCUCUAUCUUCCUCUU | 650 | AAGAGGAAGAUAGAGAAAG | 1346 |
| AGGGUGGCUUCAUGCCUCA | 651 | AGGGUGGCUUCAUGCCUCA | 651 | UGAGGCAUGAAGCCACCCU | 1347 |
| AAGACCUGGCUCCAGUCCA | 652 | AAGACCUGGCUCCAGUCCA | 652 | UGGACUGGAGCCAGGUCUU | 1348 |
| CCGGUUGCUCUUUCUCUAU | 653 | CCGGUUGCUCUUUCUCUAU | 653 | AUAGAGAAAGAGCAACCGG | 1349 |
| CGGUUGCUCUUUCUCUAUC | 654 | CGGUUGCUCUUUCUCUAUC | 654 | GAUAGAGAAAGAGCAACCG | 1350 |
| UGGGGGAUUUCCACUACGU | 655 | UGGGGGAUUUCCACUACGU | 655 | ACGUAGUGGAAAUCCCCCA | 1351 |
| AUGUCACGAACGACUGCUC | 656 | AUGUCACGAACGACUGCUC | 656 | GAGCAGUCGUUCGUGACAU | 1352 |
| GGCCUAGUUGGGGCCCCAC | 657 | GGCCUAGUUGGGGCCCCAC | 657 | GUGGGGCCCCAACUAGGCC | 1353 |
| UGGACCAAGCGGAGACGGC | 658 | UGGACCAAGCGGAGACGGC | 658 | GCCGUCUCCGCUUGGUCCA | 1354 |
| UUCCAGGUCGGGCUCAACC | 659 | UUCCAGGUCGGGCUCAACC | 659 | GGUUGAGCCCGACCUGGAA | 1355 |
| AGCGGGUCGAGUUCCUGGU | 660 | AGCGGGUCGAGUUCCUGGU | 660 | ACCAGGAACUCGACCCGCU | 1356 |
| CAAGGAGAUGAAGGCGAAG | 661 | CAAGGAGAUGAAGGCGAAG | 661 | CUUCGCCUUCAUCUCCUUG | 1357 |
| CAUGUCACGAACGACUGCU | 662 | CAUGUCACGAACGACUGCU | 662 | AGCAGUCGUUCGUGACAUG | 1358 |
| CAGCGGGUCGAGUUCCUGG | 663 | CAGCGGGUCGAGUUCCUGG | 663 | CCAGGAACUCGACCCGCUG | 1359 |
| UUCCACUACGUGACGGGCA | 664 | UUCCACUACGUGACGGGCA | 664 | UGCCCGUCACGUAGUGGAA | 1360 |
| UAGGGUGGCUUCAUGCCUC | 665 | UAGGGUGGCUUCAUGCCUC | 665 | GAGGCAUGAAGCCACCCUA | 1361 |
| UCCAGGACUGCACGAUGCU | 666 | UCCAGGACUGCACGAUGCU | 666 | AGCAUCGUGCAGUCCUGGA | 1362 |
| UCCACUACGUGACGGGCAU | 667 | UCCACUACGUGACGGGCAU | 667 | AUGCCCGUCACGUAGUGGA | 1363 |
| AAUAGGGUGGCUUCAUGCC | 668 | AAUAGGGUGGCUUCAUGCC | 668 | GGCAUGAAGCCACCCUAUU | 1364 |
| GUCUUCACGGAGGCUAUGA | 669 | GUCUUCACGGAGGCUAUGA | 669 | UCAUAGCCUCCGUGAAGAC | 1365 |
| AUAGGGUGGCUUCAUGCCU | 670 | AUAGGGUGGCUUCAUGCCU | 670 | AGGCAUGAAGCCACCCUAU | 1366 |
| UCUUCACGGAGGCUAUGAC | 671 | UCUUCACGGAGGCUAUGAC | 671 | GUCAUAGCCUCCGUGAAGA | 1367 |
| AUGCCUCAGGAAACUUGGG | 672 | AUGCCUCAGGAAACUUGGG | 672 | CCCAAGUUUCCUGAGGCAU | 1368 |
| ACCGGGACGUGCUCAAGGA | 673 | ACCGGGACGUGCUCAAGGA | 673 | UCCUUGAGCACGUCCCGGU | 1369 |
| GGGGCUGUGCAGUGGAUGA | 674 | GGGGCUGUGCAGUGGAUGA | 674 | UCAUCCACUGCACAGCCCC | 1370 |
| AAGCUCCAGGACUGCACGA | 675 | AAGCUCCAGGACUGCACGA | 675 | UCGUGCAGUCCUGGAGCUU | 1371 |
| GCUCCAGGACUGCACGAUG | 676 | GCUCCAGGACUGCACGAUG | 676 | CAUCGUGCAGUCCUGGAGC | 1372 |
| UACCGGGACGUGCUCAAGG | 677 | UACCGGGACGUGCUCAAGG | 677 | CCUUGAGCACGUCCCGGUA | 1373 |
| GGGCUGUGCAGUGGAUGAA | 678 | GGGCUGUGCAGUGGAUGAA | 678 | UUCAUCCACUGCACAGCCC | 1374 |

TABLE II-continued

HCV siNA and Target Sequences
GenBank Accession No. D11168 (HCV)

| Sequence | SeqID | Upper seq | Seq ID | Lower seq | Seq ID |
|---|---|---|---|---|---|
| CGUCAAGUUCCCGGGCGGU | 679 | CGUCAAGUUCCCGGGCGGU | 679 | ACCGCCCGGGAACUUGACG | 1375 |
| UCAAUAGGGUGGCUUCAUG | 680 | UCAAUAGGGUGGCUUCAUG | 680 | CAUGAAGCCACCCUAUUGA | 1376 |
| AGUCUUCACGGAGGCUAUG | 681 | AGUCUUCACGGAGGCUAUG | 681 | CAUAGCCUCCGUGAAGACU | 1377 |
| GGACCAAGCGGAGACGGCU | 682 | GGACCAAGCGGAGACGGCU | 682 | AGCCGUCUCCGCUUGGUCC | 1378 |
| GGCUCCAGUCCAAGCUCCU | 683 | GGCUCCAGUCCAAGCUCCU | 683 | AGGAGCUUGGACUGGAGCC | 1379 |
| GGCUGUGCAGUGGAUGAAC | 684 | GGCUGUGCAGUGGAUGAAC | 684 | GUUCAUCCACUGCACAGCC | 1380 |
| CUCCAGGACUGCACGAUGC | 685 | CUCCAGGACUGCACGAUGC | 685 | GCAUCGUGCAGUCCUGGAG | 1381 |
| GAGUCUUCACGGAGGCUAU | 686 | GAGUCUUCACGGAGGCUAU | 686 | AUAGCCUCCGUGAAGACUC | 1382 |
| UGGCUCCAGUCCAAGCUCC | 687 | UGGCUCCAGUCCAAGCUCC | 687 | GGAGCUUGGACUGGAGCCA | 1383 |
| GGGGAUUUCCACUACGUGA | 688 | GGGGAUUUCCACUACGUGA | 688 | UCACGUAGUGGAAAUCCCC | 1384 |
| CAUGCCUCAGGAAACUUGG | 689 | CAUGCCUCAGGAAACUUGG | 689 | CCAAGUUUCCUGAGGCAUG | 1385 |
| AUCAAUAGGGUGGCUUCAU | 690 | AUCAAUAGGGUGGCUUCAU | 690 | AUGAAGCCACCCUAUUGAU | 1386 |
| GCGGGCCUUGCCUACUAUU | 691 | GCGGGCCUUGCCUACUAUU | 691 | AAUAGUAGGCAAGGCCCGC | 1387 |
| CCGGGACGUGCUCAAGGAG | 692 | CCGGGACGUGCUCAAGGAG | 692 | CUCCUUGAGCACGUCCCGG | 1388 |
| CCAUGGUGGGAACUGGGC | 693 | CCAUGGUGGGGAACUGGGC | 693 | GCCCAGUUCCCCACCAUGG | 1389 |
| CAAUAGGGUGGCUUCAUGC | 694 | CAAUAGGGUGGCUUCAUGC | 694 | GCAUGAAGCCACCCUAUUG | 1390 |
| AGCUCCAGGACUGCACGAU | 695 | AGCUCCAGGACUGCACGAU | 695 | AUCGUGCAGUCCUGGAGCU | 1391 |
| CGGGCCUUGCCUACUAUUC | 696 | CGGGCCUUGCCUACUAUUC | 696 | GAAUAGUAGGCAAGGCCCG | 1392 |

The 3'-ends of the Upper sequence and the Lower sequence of the siNA construct can include an overhang sequence, for example about 1, 2, 3, or 4 nucleotides in length, preferably 2 nucleotides in length, wherein the overhanging sequence of the lower sequence is optionally complementary to a portion of the target sequence. The upper sequence is also referred to as the sense strand, whereas the lower sequence is also referred to as the anitsense strand. The upper and lower sequences in the Table can further comprise a chemical modification having Formulae I-VII or any combination thereof.

TABLE III

HCV Synthetic Modified siNA constructs

| Target Pos | Target | Seq ID | Compound # | Aliases | Sequence | Seq ID |
|---|---|---|---|---|---|---|
| 177 | GGUCCUUUCUUGGAUCAACCCGC | 1393 | 25237 | HCV IRES Loop IIIb (Heptazyme site) as siNA str1 (sense) + 5'/3'-invAba | B GGUCCUUUCUUGGAUCAACCC B | 1413 |
| 177 | GGUCCUUUCUUGGAUCAACCCGC | 1393 | 25238 | HCV IRES Loop IIIb (Heptazyme site) as siNA str2 (antisense) + 5'/3'-invAba | B GGGUUGAUCCAAGAAAGGACC B | 1414 |
| 177 | GGUCCUUUCUUGGAUCAACCCGC | 1393 | 25251 | HCV IRES Loop IIIb (Heptazyme site) as siNA str1 (sense) Inverted Control + 5'/3'-invAba | B CCCAACUAGGUUCUUUCCUGG B | 1415 |
| 177 | GGUCCUUUCUUGGAUCAACCCGC | 1393 | 25252 | HCV IRES Loop IIIb (Heptazyme site) as siNA str1 (sense) Inverted Control Compliment + 5'/3'-invAba | B CCAGGAAAGAACCUAGUUGGG B | 1416 |
| 177 | GGUCCUUUCUUGGAUCAACCCGC | 1393 | 25814 | HCV IRES Loop IIIb (Heptazyme site) as siNA str1 (sense) + 2U overhang | GGUCCUUUCUUGGAUCAACCCUU | 1417 |

TABLE III-continued

HCV Synthetic Modified siNA constructs

| Target Pos | Target | Seq ID | Compound # | Aliases | Sequence | Seq ID |
|---|---|---|---|---|---|---|
| 177 | GGUCCUUUCUUGGAUCAACCCGC | 1393 | 25815 | HCV IRES Loop IIIb (Heptazyme site) as siNA str2 (antisense) + 2U overhang | GGGUUGAUCCAAGAAAGGACCUU | 1418 |
| 177 | GGUCCUUUCUUGGAUCAACCCGC | 1393 | 25834 | HCV IRES Loop IIIb (Heptazyme site) as siNA str1 (sense) + 2U overhang + 5'/3'-invAba | BGGUCCUUUCUUGGAUCAACCCUUB | 1419 |
| 177 | GGUCCUUUCUUGGAUCAACCCGC | 1393 | 25835 | HCV IRES Loop IIIb (Heptazyme site) as siNA str2 (antisense) + 2U overhang + 5'/3'-invAba | BGGGUUGAUCCAAGAAAGGACCUUB | 1420 |
| 323 | UGCCCCGGGAGGUCUCGUAGACC | 1394 | 28415 | HCV-Luc: 325U21 TT siNA sense | CCCCGGGAGGUCUCGUAGATT | 1421 |
| 160 | UGCGGAACCGGUGAGUACACCGG | 1395 | 28416 | HCV-Luc: 162U21 TT siNA sense | CGGAACCGGUGAGUACACCTT | 1422 |
| 322 | GUGCCCCGGGAGGUCUCGUAGAC | 1396 | 28417 | HCV-Luc: 324U21 TT siNA sense | GCCCCGGGAGGUCUCGUAGTT | 1423 |
| 161 | GCGGAACCGGUGAGUACACCGGA | 1397 | 28418 | HCV-Luc: 163U21 TT siNA sense | GGAACCGGUGAGUACACCGTT | 1424 |
| 292 | UUGUGGUACUGCCUGAUAGGGUG | 1398 | 28419 | HCV-Luc: 294U21 TT siNA sense | GUGGUACUGCCUGAUAGGGTT | 1425 |
| 291 | CUUGUGGUACUGCCUGAUAGGGU | 1399 | 28420 | HCV-Luc: 293U21 TT siNA sense | UGUGGUACUGCCUGAUAGGTT | 1426 |
| 290 | CCUUGUGGUACUGCCUGAUAGGG | 1400 | 28421 | HCV-Luc: 292U21 TT siNA sense | UUGUGGUACUGCCUGAUAGTT | 1427 |
| 323 | UGCCCCGGGAGGUCUCGUAGACC | 1394 | 28422 | HCV-Luc: 343L21 TT siNA (325C) antisense | UCUACGAGACCUCCCGGGGTT | 1428 |
| 160 | UGCGGAACCGGUGAGUACACCGG | 1395 | 28423 | HCV-Luc: 180L21 TT siNA (162C) antisense | GGUGUACUCACCGGUUCCGTT | 1429 |
| 322 | GUGCCCCGGGAGGUCUCGUAGAC | 1396 | 28424 | HCV-Luc: 342L21 TT siNA (324C) antisense | CUACGAGACCUCCCGGGGCTT | 1430 |
| 161 | GCGGAACCGGUGAGUACACCGGA | 1397 | 28425 | HCV-Luc: 181L21 TT siNA (163C) antisense | CGGUGUACUCACCGGUUCCTT | 1431 |
| 292 | UUGUGGUACUGCCUGAUAGGGUG | 1398 | 28426 | HCV-Luc: 312L21 TT siNA (294C) antisense | CCCUAUCAGGCAGUACCACTT | 1432 |
| 291 | CUUGUGGUACUGCCUGAUAGGGU | 1399 | 28427 | HCV-Luc: 311L21 TT siNA (293C) antisense | CCUAUCAGGCAGUACCACATT | 1433 |
| 290 | CCUUGUGGUACUGCCUGAUAGGG | 1400 | 28428 | HCV-Luc: 310L21 TT siNA (292C) antisense | CUAUCAGGCAGUACCACAATT | 1434 |
| 323 | UGCCCCGGGAGGUCUCGUAGACC | 1394 | 28429 | HCV-Luc: 325U21 TT siNA inv sense | TTAGAUGCUCUGGAGGGCCCC | 1435 |
| 160 | UGCGGAACCGGUGAGUACACCGG | 1395 | 28430 | HCV-Luc: 162U21 TT siNA inv sense | TTCCACAUGAGUGGCCAAGGC | 1436 |
| 322 | GUGCCCCGGGAGGUCUCGUAGAC | 1396 | 28431 | HCV-Luc: 324U21 TT siNA inv sense | TTGAUGCUCUGGAGGGCCCGG | 1437 |
| 161 | GCGGAACCGGUGAGUAGACCGGA | 1397 | 28432 | HCV-Luc: 163U21 TT siNA inv sense | TTGCCACAUGAGUGGCCAAGG | 1438 |
| 292 | UUGUGGUACUGCCUGAUAGGGUG | 1398 | 28433 | HCV-Luc: 294U21 TT siNA inv sense | TTGGGAUAGUCCGUCAUGGUG | 1439 |
| 291 | CUUGUGGUACUGCCUGAUAGGGU | 1399 | 28434 | HCV-Luc: 293U21 TT siNA inv sense | TTGGAUAGUCCGUCAUGGUGU | 1440 |
| 290 | CCUUGUGGUAGUGCCUGAUAGGG | 1400 | 28435 | HCV-Luc: 292U21 TT siNA inv sense | TTGAUAGUCCGUCAUGGUGUU | 1441 |
| 323 | UGCCCCGGGAGGUCUCGUAGACC | 1394 | 28436 | HCV-Luc: 343L21 TT siNA (325C) inv antisense | TTGGGGGCCUGCAGAGCAUCU | 1442 |
| 160 | UGCGGAACCGGUGAGUACACCGG | 1395 | 28437 | HCV-Luc: 180L21 TT siNA (162C) inv antisense | TTGCCUUGGCCACUCAUGUGG | 1443 |

TABLE III-continued

HCV Synthetic Modified siNA constructs

| Target Pos | Target | Seq ID | Compound # | Aliases | Sequence | Seq ID |
|---|---|---|---|---|---|---|
| 322 | GUGCCCCGGGAGGUCUCGUAGAC | 1396 | 28438 | HCV-Luc: 342L21 TT siNA (324C) inv antisense | TTCGGGGCCCUCCAGAGCAUC | 1444 |
| 161 | GCGGAACCGGUGAGUACACCGGA | 1397 | 28439 | HCV-Luc: 181L21 TT siNA (163C) inv antisense | TTCCUUGGCCACUCAUGUGGC | 1445 |
| 292 | UUGUGGUACUGCCUGAUAGGGUG | 1398 | 28440 | HCV-Luc: 312L21 TT siNA (294C) inv antisense | TTCACCAUGACGGACUAUCCC | 1446 |
| 291 | CUUGUGGUACUGCCUGAUAGGGU | 1399 | 28441 | HCV-Luc: 311L21 TT siNA (293C) inv antisense | TTACACCAUGACGGACUAUCC | 1447 |
| 290 | CCUUGUGGUACUGCCUGAUAGGG | 1400 | 28442 | HCV-Luc: 310L21 TT siNA (292C) inv antisense | TTAACACCAUGACGGACUAUC | 1448 |
| 160 | UGCGGAACCGGUGAGUACACCGG | 1395 | 29573 | HCV-Luc: 162U21 siNA sense | CGGAACCGGUGAGUACACCGG | 1449 |
| 161 | GCGGAACCGGUGAGUACACCGGA | 1397 | 29574 | HCV-Luc: 163U21 siNA sense | GGAACCGGUGAGUACACCGGA | 1450 |
| 290 | CCUUGUGGUACUGCCUGAUAGGG | 1400 | 29575 | HCV-Luc: 292U21 siNA sense | UUGUGGUACUGCCUGAUAGGG | 1451 |
| 291 | CUUGUGGUACUGCCUGAUAGGGU | 1399 | 29576 | HCV-Luc: 293U21 siNA sense | UGUGGUACUGCCUGAUAGGGU | 1452 |
| 292 | UUGUGGUACUGCCUGAUAGGGUG | 1398 | 29577 | HCV-Luc: 294U21 siNA sense | GUGGUACUGCCUGAUAGGGUG | 1453 |
| 322 | GUGCCCCGGGAGGUCUCGUAGAC | 1396 | 29578 | HCV-Luc: 324U21 siNA sense | GCCCCGGGAGGUCUCGUAGAC | 1454 |
| 323 | UGCCCCGGGAGGUCUCGUAGACC | 1394 | 29579 | HCV-Luc: 325U21 siNA sense | CCCCGGGAGGUCUCGUAGACC | 1455 |
| 160 | UGCGGAACCGGUGAGUACACCGG | 1395 | 29580 | HCV-Luc: 182L21 siNA (162C) antisense | GGUGUACUCACCGGUUCCGCA | 1456 |
| 161 | GCGGAACCGGUGAGUACACCGGA | 1397 | 29581 | HCV-Luc: 183L21 siNA (163C) antisense | CGGUGUACUCACCGGUUCCGC | 1457 |
| 290 | CCUUGUGGUACUGCCUGAUAGGG | 1400 | 29582 | HCV-Luc: 312L21 siNA (292C) antisense | CUAUCAGGCAGUACCACAAGG | 1458 |
| 291 | CUUGUGGUACUGCCUGAUAGGGU | 1399 | 29583 | HCV-Luc: 313L21 siNA (293C) antisense | CCUAUCAGGCAGUACCACAAG | 1459 |
| 292 | UUGUGGUACUGCCUGAUAGGGUG | 1398 | 29584 | HCV-Luc: 314L21 siNA (294C) antisense | CCCUAUCAGGCAGUACCACAA | 1460 |
| 322 | GUGCCCCGGGAGGUCUCGUAGAC | 1396 | 29585 | HCV-Luc: 344L21 siNA (324C) antisense | CUACGAGACCUCCCGGGGCAC | 1461 |
| 323 | UGCCCCGGGAGGUCUCGUAGACC | 1394 | 29586 | HCV-Luc: 345L21 siNA (325C) antisense | UCUACGAGACCUCCCGGGGCA | 1462 |
| 160 | UGCGGAACCGGUGAGUACACCGG | 1395 | 29587 | HCV-Luc: 162U21 siNA inv sense | GGCCACAUGAGUGGCCAAGGC | 1463 |
| 161 | GCGGAACCGGUGAGUACACCGGA | 1397 | 29588 | HCV-Luc: 163U21 siNA inv sense | AGGCCACAUGAGUGGCCAAGG | 1464 |
| 290 | CCUUGUGGUACUGCCUGAUAGGG | 1400 | 29589 | HCV-Luc: 292U21 siNA inv sense | GGGAUAGUCCGUCAUGGUGUU | 1465 |
| 291 | CUUGUGGUACUGCCUGAUAGGGU | 1399 | 29590 | HCV-Luc: 293U21 siNA inv sense | UGGGAUAGUCCGUCAUGGUGU | 1466 |
| 292 | UUGUGGUACUGCCUGAUAGGGUG | 1398 | 29591 | HCV-Luc: 294U21 siNA inv sense | GUGGGAUAGUCCGUCAUGGUG | 1467 |
| 322 | GUGCCCCGGGAGGUCUCGUAGAC | 1396 | 29592 | HCV-Luc: 324U21 siNA inv sense | CAGAUGCUCUGGAGGGCCCCG | 1468 |
| 323 | UGCCCCGGGAGGUCUCGUAGACC | 1394 | 29593 | HCV-Luc: 325U21 siNA inv sense | CCAGAUGCUCUGGAGGGCCCC | 1469 |
| 160 | UGCGGAACCGGUGAGUACACCGG | 1395 | 29594 | HCV-Luc: 182L21 siNA (162C) inv antisense | ACGCCUUGGCCACUCAUGUGG | 1470 |
| 161 | GCGGAACCGGUGAGUACACCGGA | 1397 | 29595 | HCV-Luc: 183L21 siNA (163C) inv antisense | CGCCUUGGCCACUCAUGUGGC | 1471 |
| 290 | CCUUGUGGUACUGCCUGAUAGGG | 1400 | 29596 | HCV-Luc: 312L21 siNA (292C) inv antisense | GGAACACCAUGACGGACUAUC | 1472 |

TABLE III-continued

HCV Synthetic Modified siNA constructs

| Target Pos | Target | Seq ID | Compound # | Aliases | Sequence | Seq ID |
|---|---|---|---|---|---|---|
| 291 | CUUGUGGUACUGCCUGAUAGGGU | 1399 | 29597 | HCV-Luc: 313L21 siNA (293C) inv antisense | GAACACCAUGACGGACUAUCC | 1473 |
| 292 | UUGUGGUACUGCCUGAUAGGGUG | 1398 | 29598 | HCV-Luc: 314L21 siNA (294C) inv antisense | AACACCAUGACGGACUAUCCG | 1474 |
| 322 | GUGCCCGGGGAGGUCUCGUAGAC | 1396 | 29599 | HCV-Luc: 344L21 siNA (324C) inv antisense | CACGGGGCCCUCCAGAGCAUC | 1475 |
| 323 | UGCCCCGGGGAGGUCUCGUAGACC | 1394 | 29600 | HCV-Luc: 345L21 siNA (325C) inv antisense | ACGGGGCCCUCCAGAGCAUCU | 1476 |
| 323 | UGCCCCGGGGAGGUCUCGUAGACC | 1394 | 30051 | HCV-Luc: 325U21 siNA 5 5' P = S + 3' univ. base 2 + 5'/3' invAba sense | BCsCsCsCsGsGGAGGUCUCGUAGA XXB | 1477 |
| 323 | UGCCCCGGGGAGGUCUCGUAGACC | 1394 | 30052 | HCV-Luc: 325U21 siNA inv 5 5' P = S + 3' univ. base 2 + 5'/3' invAba sense | BAsGsAsUsGsCUCUGGAGGGCCCC XXB | 1478 |
| 323 | UGCCCCGGGGAGGUCUCGUAGACC | 1394 | 30053 | HCV-Luc: 345L21 siNA (325C) 5 5' P = S + 3' univ. base 2 + 3' invAba antisense | UsCsUsAsCsGAGACCUCCCGGGG XXB | 1479 |
| 323 | UGCCCCGGGGAGGUCUCGUAGACC | 1394 | 30054 | HCV-Luc: 345L21 siNA (325C) inv 5 5' P = S + 3' univ. base 2 + 3' invAba antisense | GsGsGsGsCsCCUCCAGAGCAUCU XXB | 1480 |
| 323 | UGCCCCGGGGAGGUCUCGUAGACC | 1394 | 30055 | HCV-Luc: 325U21 siNA all Y P = S + 3' univ. base 2 + 5'/3' invAba sense | BCsCsCsCsGGGAGGUsCsUsCsGU sAGAXXB | 1481 |
| 323 | UGCCCCGGGGAGGUCUCGUAGACC | 1394 | 30056 | HCV-Luc: 325U21 siNA inv all Y P = S + 3' univ. base 2 + 5'/3' invAba sense | BAGAUsGCsUsCsUsGGAGGGCsCs CsCsXXB | 1482 |
| 323 | UGCCCCGGGGAGGUCUCGUAGACC | 1394 | 30057 | HCV-Luc: 345L21 siNA (325C) all Y P = S + 3' univ. base 2 + 3' invAba antisense | UsCsUsACsGAGACsCsUsCsCsCs GGGGXXB | 1483 |
| 323 | UGCCCCGGGGAGGUCUCGUAGACC | 1394 | 30058 | HCV-Luc: 345L21 siNA (325C) inv all Y P = S + 3' univ. base 2 + 3' invAba antisense | GGGGCsCsCsUsCsCsAGAGCsAUs CsUsXXB | 1484 |
| 323 | UGCCCCGGGGAGGUCUCGUAGACC | 1394 | 30059 | HCV-Luc: 325U21 siNA 4/3 P = S ends + all Y-2'F + 3' univ. base 2 + 5'/3' invAba sense | BcscscscsGGGAGGucucGuAsGs AsXXB | 1485 |
| 323 | UGCCCCGGGGAGGUCUCGUAGACC | 1394 | 30060 | HCV-Luc: 325U21 siNA inv 4/3 P = S ends + all Y-2'F + 3' univ. base 2 + 5'/3' invAba sense | BAsGsAsusGcucuGGAGGGccscs csXXB | 1486 |
| 323 | UGCCCCGGGGAGGUCUCGUAGACC | 1394 | 30170 | HCV-Luc: 325U21 siNA all Y-2'F + 3' univ. base 2 + 5'/3' invAba sense | B ccccGGGAGGucucGuAGAXX B | 1487 |
| 323 | UGCCCCGGGGAGGUCUCGUAGACC | 1394 | 30171 | HCV-Luc: 325U21 siNA inv all Y-2'F + 3' univ. base 2 + 5'/3' invAba sense | B AGAuGcucuGGAGGGccccXX B | 1488 |
| 323 | UGCCCCGGGGAGGUCUCGUAGACC | 1394 | 30172 | HCV-Luc: 345L21 siNA (325C) all Y P = S + 3' univ. base 2 + 5'/ 3' invAba antisense | B UsCsUsACsGAGACsCsUsCsCsC sGGGGXX B | 1489 |
| 323 | UGCCCCGGGGAGGUCUCGUAGACC | 1394 | 30173 | HCV-Luc: 345L21 siNA (325C) all Y-2'F antisense | ucuAcGAGAccucccGGGG | 1490 |
| 323 | UGCCCCGGGGAGGUCUCGUAGACC | 1394 | 30175 | HCV-Luc: 345L21 siNA (325C) all Y-2'F + 3' univ. base 2 antisense | ucuAcGAGAccucccGGGGXX | 1491 |

TABLE III-continued

HCV Synthetic Modified siNA constructs

| Target Pos | Target | Seq ID | Compound # | Aliases | Sequence | Seq ID |
|---|---|---|---|---|---|---|
| 323 | UGCCCCGGGAGGUCUCGUAGACC | 1394 | 30176 | HCV-Luc: 345L21 siNA (325C) inv all Y-2'F + 3' univ. base 2 antisense | GGGGcccuccAGAGcAucuXX | 1492 |
| 323 | UGCCCCGGGAGGUCUCGUAGACC | 1394 | 30177 | HCV-Luc: 345L21 siNA (325C) all Y-2'F + 3' univ. base 2 + 5'/3' iB antisense | B ucuAcGAGAccuccGGGGXX B | 1493 |
| 323 | UGCCCCGGGAGGUCUCGUAGACC | 1394 | 30178 | HCV-Luc: 325U21 siNA all Y P = S + 3' univ. base 2 + 3' invAba sense | CsCsCsCsGGGAGGUsCsUsCsGUs AGAXX B | 1494 |
| 323 | UGCCCCGGGAGGUCUCGUAGACC | 1394 | 30417 | HCV-Luc: 325U21 siNA w/iB sense | CCCCGGGAGGUCUCGUAGACC B | 1495 |
| 323 | UGCCCCGGGAGGUCUCGUAGACG | 1394 | 30418 | HCV-Luc: 325U21 siNA w/iB sense B | CCCCGGGAGGUCUCGUAGACC B | 1496 |
| 323 | UGCCCCGGGAGGUCUCGUAGACC | 1394 | 30419 | HCV-Luc: 345L21 siNA (325C) w/ iB antisense | UCUACGAGACCUCCCGGGGCA B | 1497 |
| 323 | UGCCCCGGGAGGUCUCGUAGACC | 1394 | 30420 | HCV-Luc: 345L21 siNA (325C) w/ iB antisense | B UCUACGAGACCUCCCGGGGCA B | 1498 |
| 323 | UGGCCCGGGAGGUCUCGUAGACC | 1394 | 30561 | HCV-Luc: 325U21 siNA Y-2'OMe (stab06) + 5'/3' invAba sense | BccccGGGAGGUcucGuAGATTB | 1499 |
| 323 | UGCCCCGGGAGGUCUCGUAGACC | 1394 | 30562 | HCV-Luc: 345L21 siNA (325C) Y-2'F, R-2'OMe + TsT antisense | ucuAcGAGAccucccGGGGTsT | 1500 |
| 151 | AUAGUGGUCUGCGGAACCGGUGA | 1401 | 30649 | HCV-Luc: 153U21 siNA stab07 sense | B AGuGGucuGcGGAAccGGuTT B | 1501 |
| 157 | GUCUGCGGAACCGGUGAGUACAC | 1402 | 30650 | HCV-Luc: 159U21 siNA stab07 sense | B cuGcGGAAccGGuGAGuAcTT B | 1502 |
| 289 | GCCUUGUGGUACUGCCUGAUAGG | 1403 | 30651 | HCV-Luc: 291U21 siNA stab07 sense | B cuuGuGGuAcuGccuGAuATT B | 1503 |
| 293 | UGUGGUACUGCCUGAUAGGGUGC | 1404 | 30652 | HCV-Luc: 295U21 siNA stab07 sense | B uGGuAcuGccuGAuAGGGuTT B | 1504 |
| 294 | GUGGUACUGCCUGAUAGGGUGCU | 1405 | 30653 | HCV-Luc: 296U21 siNA stab07 sense | B GGuAcuGccuGAuAGGGuGTT B | 1505 |
| 295 | UGGUACUGCCUGAUAGGGUGCUU | 1406 | 30654 | HCV-Luc: 297U21 siNA stab07 sense | B GuAcuGccuGAuAGGGuGcTT B | 1506 |
| 296 | GGUACUGCCUGAUAGGGUGCUUG | 1407 | 30655 | HCV-Luc: 298U21 siNA stab07 sense | B uAcuGccuGAuAGGGuGcuTT B | 1507 |
| 298 | UACUGCCUGAUAGGGUGCUUGCG | 1408 | 30656 | HCV-Luc: 300U21 siNA stab07 sense | B cuGccuGAuAGGGuGcuuGTT B | 1508 |
| 299 | ACUGCCUGAUAGGGUGCUUGCGA | 1409 | 30657 | HCV-Luc: 301U21 siNA stab07 sense | B uGccuGAuAGGGuGcuuGcTT B | 1509 |
| 301 | UGCCUGAUAGGGUGCUUGCGAGU | 1410 | 30658 | HCV-Luc: 303U21 siNA stab07 sense | B ccuGAuAGGGuGcuuGcGATT B | 1510 |
| 304 | CUGAUAGGGUGCUUGCGAGUGCC | 1411 | 30659 | HCV-Luc: 306U21 siNA stab07 sense | B GAuAGGGuGcuuGcGAGuGTT B | 1511 |
| 322 | GUGCCCCGGGAGGUCUCGUAGAC | 1396 | 30660 | HCV-Luc: 324U21 siNA stab07 sense | B GccccGGGAGGUcucGuAGTT B | 1512 |
| 151 | AUAGUGGUCUGCGGAACCGGUGA | 1401 | 30661 | HCV-Luc: 173L21 siNA (153C) stab08 antisense | AccGGuuccGcAGAccAcuTsT | 1513 |
| 157 | GUCUGCGGAACCGGUGAGUACAC | 1402 | 30662 | HCV-Luc: 179L21 siNA (159C) stab08 antisense | GuAcucAccGGuuccGcAGTsT | 1514 |
| 289 | GCCUUGUGGUACUGCCUGAUAGG | 1403 | 30663 | HCV-Luc: 311L21 siNA (291C) stab08 antisense | uAucAGGcAGuAccAcAAGTsT | 1515 |

TABLE III-continued

HCV Synthetic Modified siNA constructs

| Target Pos | Target | Seq ID | Compound # | Aliases | Sequence | Seq ID |
|---|---|---|---|---|---|---|
| 293 | UGUGGUACUGCCUGAUAGGGUGC | 1404 | 30664 | HCV-Luc: 315L21 siNA (295C) stab08 antisense | AcccuAucAGGcAGuAccATsT | 1516 |
| 294 | GUGGUACUGCCUGAUAGGGUGCU | 1405 | 30665 | HCV-Luc: 316L21 siNA (296C) stab08 antisense | cAcccuAucAGGcAGuAccTsT | 1517 |
| 295 | UGGUACUGCCUGAUAGGGUGCUU | 1406 | 30666 | HCV-Luc: 317L21 siNA (297C) stab08 antisense | GcAcccuAucAGGcAGuAcTsT | 1518 |
| 296 | GGUACUGCCUGAUAGGGUGCUUG | 1407 | 30667 | HCV-Luc: 318L21 siNA (298C) stab08 antisense | AGcAcccuAucAGGcAGuATsT | 1519 |
| 298 | UACUGCCUGAUAGGGUGCUUGCG | 1408 | 30668 | HCV-Luc: 320L21 siNA (300C) stab08 antisense | cAAGcAcccuAucAGGcAGTsT | 1520 |
| 299 | ACUGCCUGAUAGGGUGCUUGCGA | 1409 | 30669 | HCV-Luc: 321L21 siNA (301C) stab08 antisense | GcAAGcAcccuAucAGGcATsT | 1521 |
| 301 | UGCCUGAUAGGGUGCUUGCGAGU | 1410 | 30670 | HCV-Luc: 323L21 siNA (303C) stab08 antisense | ucGcAAGcAcccuAucAGGTsT | 1522 |
| 304 | CUGAUAGGGUGCUUGCGAGUGCC | 1411 | 30671 | HCV-Luc: 326L21 siNA (306C) stab08 antisense | cAcucGcAAGcAcccuAucTsT | 1523 |
| 322 | GUGCCCCGGGAGGUCUCGUAGAC | 1396 | 30672 | HCV-Luc: 344L21 siNA (324C) stab08 antisense | cuAcGAGAccucccGGGGcTsT | 1524 |
| 151 | AUAGUGGUCUGCGGAACCGGUGA | 1401 | 30673 | HCV-Luc: 153U21 siNA stab07 inv B sense | uGGccAAGGcGucuGGuGATT B | 1525 |
| 157 | GUCUGCGGAACCGGUGAGUACAC | 1402 | 30674 | HCV-Luc: 159U21 siNA stab07 inv B sense | cAuGAGuGGccAAGGcGucTT B | 1526 |
| 289 | GCCUUGUGGUACUGCCUGAUAGG | 1403 | 30675 | HCV-Luc: 291U21 siNA stab07 inv B sense | AuAGuccGucAuGGuGuucTT B | 1527 |
| 293 | UGUGGUACUGCCUGAUAGGGUGC | 1404 | 30676 | HCV-Luc: 295U21 siNA stab07 inv B sense | uGGGAuAGuccGucAuGGuTT B | 1528 |
| 294 | GUGGUACUGCCUGAUAGGGUGCU | 1405 | 30677 | HCV-Luc: 296U21 siNA stab07 inv B sense | GuGGGAuAGuccGucAuGGTT B | 1529 |
| 295 | UGGUACUGCCUGAUAGGGUGCUU | 1406 | 30678 | HCV-Luc: 297U21 siNA stab07 inv B sense | cGuGGGAuAGuccGucAuGTT B | 1530 |
| 296 | GGUACUGCCUGAUAGGGUGCUUG | 1407 | 30679 | HCV-Luc: 298U21 siNA stab07 inv B sense | ucGuGGGAuAGuccGucAuTT B | 1531 |
| 298 | UACUGCCUGAUAGGGUGCUUGCG | 1408 | 30680 | HCV-Luc: 300U21 siNA stab07 inv B sense | GuucGuGGGAuAGuccGucTT B | 1532 |
| 299 | ACUGCCUGAUAGGGUGCUUGCGA | 1409 | 30681 | HCV-Luc: 301U21 siNA stab07 inv B sense | cGuucGuGGGAuAGuccGuTT B | 1533 |
| 301 | UGCCUGAUAGGGUGCUUGCGAGU | 1410 | 30682 | HCV-Luc: 303U21 siNA stab07 inv B sense | AGcGuucGuGGGAuAGuccTT B | 1534 |
| 304 | CUGAUAGGGUGCUUGCGAGUGCC | 1411 | 30683 | HCV-Luc: 306U21 siNA stab07 inv B sense | GuGAGcGuucGuGGGAuAGTT B | 1535 |
| 322 | GUGCCCCGGGAGGUCUCGUAGAC | 1396 | 30684 | HCV-Luc: 324U21 siNA stab07 inv B sense | GAuGcucuGGAGGGccccGTT B | 1536 |
| 151 | AUAGUGGUCUGCGGAACCGGUGA | 1401 | 30685 | HCV-Luc: 173L21 siNA (153C) stab08 inv antisense | ucAccAGAcGccuuGGccATsT | 1537 |
| 157 | GUCUGCGGAACCGGUGAGUACAC | 1402 | 30686 | HCV-Luc: 179L21 siNA (159C) stab08 inv antisense | GAcGccuuGGccAcucAuGTsT | 1538 |
| 289 | GCCUUGUGGUACUGCCUGAUAGG | 1403 | 30687 | HCV-Luc: 311L21 siNA (291C) stab08 inv antisense | GAAcAccAuGAcGGAcuAuTsT | 1539 |
| 293 | UGUGGUACUGCCUGAUAGGGUGC | 1404 | 30688 | HCV-Luc: 315L21 siNA (295C) stab08 inv antisense | AccAuGAcGGAcuAucccATsT | 1540 |

TABLE III-continued

HCV Synthetic Modified siNA constructs

| Target Pos | Target | Seq ID | Compound # | Aliases | Sequence | Seq ID |
|---|---|---|---|---|---|---|
| 294 | GUGGUACUGCCUGAUAGGGUGCU | 1405 | 30689 | HCV-Luc: 316L21 siNA (296C) stab08 inv antisense | ccAuGAcGGAcuAucccAcTsT | 1541 |
| 295 | UGGUACUGCCUGAUAGGGUGCUU | 1406 | 30690 | HCV-Luc: 317L21 siNA (297C) stab08 inv antisense | cAuGAcGGAcuAucccAcGTsT | 1542 |
| 296 | GGUACUGCCUGAUAGGGUGCUUG | 1407 | 30691 | HCV-Luc: 318L21 siNA (298C) stab08 inv antisense | AuGAcGGAcuAucccAcGATsT | 1543 |
| 298 | UACUGCCUGAUAGGGUGCUUGCG | 1408 | 30692 | HCV-Luc: 320L21 siNA (300C) stab08 inv antisense | GAcGGAcuAucccAcGAAcTsT | 1544 |
| 299 | ACUGCCUGAUAGGGUGCUUGCGA | 1409 | 30693 | HCV-Luc: 321L21 siNA (301C) stab08 inv antisense | AcGGAcuAucccAcGAAcGTsT | 1545 |
| 301 | UGCCUGAUAGGGUGCUUGCGAGU | 1410 | 30694 | HCV-Luc: 323L21 siNA (303C) stab08 inv antisense | GGAcuAucccAcGAAcGcuTsT | 1546 |
| 304 | CUGAUAGGGUGCUUGCGAGUGCC | 1411 | 30695 | HCV-Luc: 326L21 siNA (306C) stab08 inv antisense | cuAucccAcGAAcGcucAcTsT | 1547 |
| 322 | GUGCCCCGGGAGGUCUCGUAGAC | 1396 | 30696 | HCV-Luc: 344L21 siNA (324C) stab08 inv antisense | cGGGGcccuccAGAGcAucTsT | 1548 |
| 323 | UGCCCCGGGAGGUCUCGUAGACC | 1394 | 31340 | HCV-Luc: 325U21 siNA stab04 sense | B ccccGGGAGGucucGuAGATT B | 1549 |
| 323 | UGCCCCGGGAGGUCUCGUAGACC | 1394 | 31341 | HCV-Luc: 325U21 siNA inv stab04 sense | B AGAuGcucuGGAGGGccccTT B | 1550 |
| 323 | UGCCCCGGGAGGUCUCGUAGACC | 1394 | 31342 | HCV-Luc: 345L21 siNA (325C) stab05 antisense | ucuAcGAGAccucccGGGGTsT | 1551 |
| 323 | UGCCCCGGGAGGUCUCGUAGACC | 1394 | 31343 | HCV-Luc: 345L21 siNA (325C) inv stab05 antisene | GGGGcccuccAGAGcAucuTsT | 1552 |
| 323 | UGCCCCGGGAGGUCUCGUAGACC | 1394 | 31344 | HCV-Luc: 325U21 siNA stab07 sense | B ccccGGGAGGucucGuAGATT B | 1553 |
| 323 | UGCCCCGGGAGGUCUCGUAGACC | 1394 | 31345 | HCV-Luc: 325U21 siNA inv stab07 sense | B AGAuGcucuGGAGGGccccTT B | 1554 |
| 323 | UGCCCCGGGAGGUCUCGUAGACC | 1394 | 31346 | HCV-Luc: 345L21 siNA (325C) inv stab08 antisense | GGGGcccuccAGAGcAucuTsT | 1555 |
| 323 | UGCCCCGGGAGGUCUCGUAGACC | 1394 | 31347 | HCV-Luc: 345L21 siNA (325C) stab11 antisense | ucuAcGAGAccucccGGGGTsT | 1556 |
| 323 | UGCCCCGGGAGGUCUCGUAGACC | 1394 | 31348 | HCV-Luc: 345L21 siNA (325C) inv stab11 antisense | GGGGcccuccAGAGcAucuTsT | 1557 |
| 151 | AUAGUGGUCUGCGGAACCGGUGA | 1401 | 31453 | HCV-Luc: 153U21 siNA stab04 sense | B AGuGGucuGcGGAAccGGuTT B | 1558 |
| 157 | GUCUGCGGAACCGGUGAGUACAC | 1402 | 31454 | HCV-Luc: 159U21 siNA stab04 sense | B cuGcGGAAccGGuGAGuAcTT B | 1559 |
| 285 | AAAGGCCUUGUGGUACUGCCUGA | 1412 | 31455 | HCV-Luc: 287U21 siNA stab04 sense | B AGGccuuGuGGuAcuGccuTT B | 1560 |
| 289 | GCCUUGUGGUACUGCCUGAUAGG | 1403 | 31456 | HCV-Luc: 291U21 siNA stab04 sense | B cuuGuGGuAcuGccuGAuATT B | 1561 |
| 293 | UGUGGUACUGCGUGAUAGGGUGC | 1404 | 31457 | HCV-Luc: 295U21 siNA stab04 sense | B uGGuAcuGccuGAuAGGGuTT B | 1562 |
| 294 | GUGGUACUGCCUGAUAGGGUGCU | 1405 | 31458 | HCV-Luc: 296U21 siNA stab04 sense | B GGuAcuGccuGAuAGGGuGTT B | 1563 |
| 295 | UGGUACUGCCUGAUAGGGUGCUU | 1406 | 31459 | HCV-Luc: 297U21 siNA stab04 sense | B GuAcuGccuGAuAGGGuGcTT B | 1564 |
| 296 | GGUACUGCCUGAUAGGGUGCUUG | 1407 | 31460 | HCV-Luc: 298U21 siNA stab04 sense | B uAcuGccuGAuAGGGuGcuTT B | 1565 |

TABLE III-continued

HCV Synthetic Modified siNA constructs

| Target Pos | Target | Seq ID | Compound # | Aliases | Sequence | Seq ID |
|---|---|---|---|---|---|---|
| 298 | UACUGCCUGAUAGGGUGCUUGCG | 1408 | 31461 | HCV-Luc: 300U21 siNA stab04 sense | B cuGccuGAuAGGGUGcuuGTT B | 1566 |
| 299 | ACUGCCUGAUAGGGUGCUUGCGA | 1409 | 31462 | HCV-Luc: 301U21 siNA stab04 sense | B uGccuGAuAGGGUGcuuGcTT B | 1567 |
| 301 | UGCCUGAUAGGGUGCUUGCGAGU | 1410 | 31463 | HCV-Luc: 303U21 siNA stab04 sense | B ccuGAuAGGGUGcuuGcGATT B | 1568 |
| 304 | CUGAUAGGGUGCUUGCGAGUGCC | 1411 | 31464 | HCV-Luc: 306U21 siNA stab04 sense | B GAuAGGGUGcuuGcGAGuGTT B | 1569 |
| 151 | AUAGUGGUCUGCGGAACCGGUGA | 1401 | 31465 | HCV-Luc: 173L21 siNA (153C) stab05 antisense | AccGGuuccGcAGAccAcuTsT | 1570 |
| 157 | GUCUGCGGAACCGGUGAGUACAC | 1402 | 31466 | HCV-Luc: 179L21 siNA (159C) stab05 antisense | GuAcucAccGGuuccGcAGTsT | 1571 |
| 285 | AAAGGCCUUGUGGUACUGCCUGA | 1412 | 31467 | HCV-Luc: 307L21 siNA (287C) stab05 antisense | AGGcAGuAccAcAAGGccuTsT | 1572 |
| 289 | GCCUUGUGGUACUGCCUGAUAGG | 1403 | 31468 | HCV-Luc: 311L21 siNA (291C) stab05 antisense | uAucAGGcAGuAccAcAAGTsT | 1573 |
| 293 | UGUGGUACUGCCUGAUAGGGUGC | 1404 | 31469 | HCV-Luc: 315L21 siNA (295C) stab05 antisense | AcccuAucAGGcAGuAccATsT | 1574 |
| 294 | GUGGUACUGCCUGAUAGGGUGCU | 1405 | 31470 | HCV-Luc: 316L21 siNA (296C) stab05 antisense | cAcccuAucAGGcAGuAccTsT | 1575 |
| 295 | UGGUACUGCCUGAUAGGGUGCUU | 1406 | 31471 | HCV-Luc: 317L21 siNA (297C) stab05 antisense | GcAcccuAucAGGcAGuAcTsT | 1576 |
| 296 | GGUACUGCCUGAUAGGGUGCUUG | 1407 | 31472 | HCV-Luc: 318L21 siNA (298C) stab05 antisense | AGcAcccuAucAGGcAGuATsT | 1577 |
| 298 | UACUGCCUGAUAGGGUGCUUGCG | 1408 | 31473 | HCV-Luc: 320L21 siNA (300C) stab05 antisense | cAAGcAcccuAucAGGcAGTsT | 1578 |
| 299 | ACUGCCUGAUAGGGUGCUUGCGA | 1409 | 31474 | HCV-Luc: 321L21 siNA (301C) stab05 antisense | GcAAGcAcccuAucAGGcATsT | 1579 |
| 301 | UGCCUGAUAGGGUGCUUGCGAGU | 1410 | 31475 | HCV-Luc: 323L21 siNA (303C) stab05 antisense | ucGcAAGcAcccuAucAGGTsT | 1580 |
| 304 | CUGAUAGGGUGCUUGCGAGUGCC | 1411 | 31476 | HCV-Luc: 326L21 siNA (306C) stab05 antisense | cAcucGcAAGcAcccuAucTsT | 1581 |
| 151 | AUAGUGGUCUGCGGAACCGGUGA | 1401 | 31477 | HCV-Luc: 153U21 siNA inv stab04 sense | B uGGccAAGGcGucuGGuGATT B | 1582 |
| 157 | GUCUGCGGAACCGGUGAGUACAC | 1402 | 31478 | HCV-Luc: 159U21 siNA inv stab04 sense | B cAuGAGuGGccAAGGcGucTT B | 1583 |
| 285 | AAAGGCCUUGUGGUACUGCCUGA | 1412 | 31479 | HCV-Luc: 287U21 siNA inv stab04 sense | B uccGucAuGGuGuuccGGATT B | 1584 |
| 289 | GCCUUGUGGUACUGCCUGAUAGG | 1403 | 31480 | HCV-Luc: 291U21 siNA inv stab04 sense | B AuAGuccGucAuGGuGuucTT B | 1585 |
| 293 | UGUGGUACUGCCUGAUAGGGUGC | 1404 | 31481 | HCV-Luc: 295U21 siNA inv stab04 sense | B uGGGAuAGuccGucAuGGuTT B | 1586 |
| 294 | GUGGUACUGCCUGAUAGGGUGCU | 1405 | 31482 | HCV-Luc: 296U21 siNA inv stab04 sense | B GuGGGAuAGuccGucAuGGTT B | 1587 |
| 295 | UGGUACUGCCUGAUAGGGUGCUU | 1406 | 31483 | HCV-Luc: 297U21 siNA inv stab04 sense | B cGuGGGAuAGuccGucAuGTT B | 1588 |
| 296 | GGUACUGCCUGAUAGGGUGCUUG | 1407 | 31484 | HCV-Luc: 298U21 siNA inv stab04 sense | B ucGuGGGAuAGuccGucAuTT B | 1589 |
| 298 | UACUGCCUGAUAGGGUGCUUGCG | 1408 | 31485 | HCV-Luc: 300U21 siNA inv stab04 sense | B GuucGuGGGAuAGuccGucTT B | 1590 |

TABLE III-continued

HCV Synthetic Modified siNA constructs

| Target Pos | Target | Seq ID | Compound # | Aliases | Sequence | Seq ID |
|---|---|---|---|---|---|---|
| 299 | ACUGCCUGAUAGGGUGCUUGCGA | 1409 | 31486 | HCV-Luc: 301U21 siNA inv stab04 sense | B cGuucGuGGGAuAGuccGuTT B | 1591 |
| 301 | UGCCUGAUAGGGUGCUUGCGAGU | 1410 | 31487 | HCV-Luc: 303U21 siNA inv stab04 sense | B AGcGuucGuGGGAuAGuccTT B | 1592 |
| 304 | CUGAUAGGGUGCUUGCGAGUGCC | 1411 | 31488 | HCV-Luc: 306U21 siNA inv stab04 sense | B GuGAGcGuucGuGGGAuAGTT B | 1593 |
| 151 | AUAGUGGUCUGCGGAACCGGUGA | 1401 | 31489 | HCV-Luc: 173L21 siNA (153C) inv stab05 antisense | ucAccAGAcGccuuGGccATsT | 1594 |
| 157 | GUCUGCGGAACCGGUGAGUACAC | 1402 | 31490 | HCV-Luc: 179L21 siNA (159C) inv stab05 antisense | GAcGccuuGGccAcucAuGTsT | 1595 |
| 285 | AAAGGCCUUGUGGUACUGCCUGA | 1412 | 31491 | HCV-Luc: 307L21 siNA (287C) inv stab05 antisense | uccGGAAcAccAuGAcGGATsT | 1596 |
| 289 | GCCUUGUGGUACUGCCUGAUAGG | 1403 | 31492 | HCV-Luc: 311L21 siNA (291C) inv stab05 antisense | GAAcAccAuGAcGGAcuAuTsT | 1597 |
| 293 | UGUGGUACUGCCUGAUAGGGUGC | 1404 | 31493 | HCV-Luc: 315L21 siNA (295C) inv stab05 antisense | AccAuGAcGGAcuAucccATsT | 1598 |
| 294 | GUGGUACUGCCUGAUAGGGUGCU | 1405 | 31494 | HCV-Luc: 316L21 siNA (296C) inv stab05 antisense | ccAuGAcGGAcuAucccAcTsT | 1599 |
| 295 | UGGUACUGCCUGAUAGGGUGCUU | 1406 | 31495 | HCV-Luc: 317L21 siNA (297C) inv stab05 antisense | cAuGAcGGAcuAucccAcGTsT | 1600 |
| 296 | GGUACUGCCUGAUAGGGUGCUUG | 1407 | 31496 | HCV-Luc: 318L21 siNA (298C) inv stab05 antisense | AuGAcGGAcuAucccAcGATsT | 1601 |
| 298 | UACUGCCUGAUAGGGUGCUUGCG | 1408 | 31497 | HCV-Luc: 320L21 siNA (300C) inv stab05 antisense | GAcGGAcuAucccAcGAAcTsT | 1602 |
| 299 | ACUGCCUGAUAGGGUGCUUGCGA | 1409 | 31498 | HCV-Luc: 321L21 siNA (301C) inv stab05 antisense | AcGGAcuAucccAcGAAcGTsT | 1603 |
| 301 | UGCCUGAUAGGGUGCUUGCGAGU | 1410 | 31499 | HCV-Luc: 323L21 siNA (303C) inv stab05 antisense | GGAcuAucccAcGAAcGcuTsT | 1604 |
| 304 | CUGAUAGGGUGCUUGCGAGUGCC | 1411 | 31500 | HCV-Luc: 326L21 siNA (306C) inv stab05 antisense | cuAucccAcGAAcGcucAcTsT | 1605 |
| 0 | GGGUCCUUUCUUGGAUCAACCCG | 1606 | 31659 | HCVb: 190U21 siNA stab04 sense | B GuccuuucuuGGAucAAccTT B | 1613 |
| 0 | GGUCCUUUCUUGGAUCAACCCGC | 1393 | 31660 | HCVb: 191U21 siNA stab04 sense | B uccuuucuuGGAucAAcccTT B | 1614 |
| 0 | CGGGUCCUUUCUUGGAUCAACCC | 1607 | 31661 | HCVb: 189U21 siNA stab04 sense | B GGuccuuucuuGGAucAAcTT B | 1615 |
| 0 | GACCGGGUCCUUUCUUGGAUCAA | 1608 | 31662 | HCVb: 186U21 siNA stab04 sense | B ccGGGuccuuucuuGGAucTT B | 1616 |
| 0 | GGGUCCUUUCUUGGAUCAACCCG | 1606 | 31663 | HCVb: 208L21 siNA (190C) stab05 antisense | GGuuGAuccAAGAAAGGAcTsT | 1617 |
| 0 | GGUCCUUUCUUGGAUCAACCCGC | 1393 | 31664 | HCVb: 209L21 siNA (191C) stab05 antisense | GGGuuGAuccAAGAAAGGATsT | 1618 |
| 0 | CGGGUCCUUUCUUGGAUCAACCC | 1607 | 31665 | HCVb: 207L21 siNA (189C) stab05 antisense | GuuGAuccAAGAAAGGAccTsT | 1619 |
| 0 | GACCGGGUCCUUUCUUGGAUCAA | 1608 | 31666 | HCVb: 204L21 siNA (186C) stab05 antisense | GAuccAAGAAAGGAcccGGTsT | 1620 |
| 0 | GGGUCCUUUCUUGGAUCAACCCG | 1606 | 31667 | HCVb: 190U21 siNA inv stab04 sense | B ccAAcuAGGuucuuuccuGTT B | 1621 |
| 0 | GGUCCUUUCUUGGAUCAACCCGC | 1393 | 31668 | HCVb: 191U21 siNA inv stab04 sense | B cccAAcuAGGuucuuuccuTT B | 1622 |
| 0 | CGGGUCCUUUCUUGGAUCAACCC | 1607 | 31669 | HCVb: 189U21 siNA inv stab04 sense | B cAAcuAGGuucuuuccuGGTT B | 1623 |

TABLE III-continued

HCV Synthetic Modified siNA constructs

| Target Pos | Target | Seq ID | Compound # | Aliases | Sequence | Seq ID |
|---|---|---|---|---|---|---|
| 0 | GACCGGGUCCUUUCUUGGAUCAA | 1608 | 31670 | HCVb: 186U21 siNA inv stab04 sense | B cuAGGuucuuuccuGGGccTT B | 1624 |
| 0 | GGGUCCUUUCUUGGAUCAACCCG | 1606 | 31671 | HCVb: 208L21 siNA (190C) inv stab05 antisense | cAGGAAAGAAccuAGuuGGTsT | 1625 |
| 0 | GGUCCUUUCUUGGAUCAACCCGC | 1393 | 31672 | HCVb: 209L21 siNA (191C) inv stab05 antisense | AGGAAAGAAccuAGuuGGGTsT | 1626 |
| 0 | CGGGUCCUUUCUUGGAUGAACCC | 1607 | 31673 | HCVb: 207L21 siNA (189C) inv stab05 antisense | ccAGGAAAGAAccuAGuuGTsT | 1627 |
| 0 | GACCGGGUCCUUUCUUGGAUCAA | 1608 | 31674 | HCVb: 204L21 siNA (186C) inv stab05 antisense | GGcccAGGAAAGAAccuAGTsT | 1628 |
| 0 | GCCCCGGGAGGUCUCGUAGACCG | 1609 | 31702 | HCVa: 326U21 siNA stab07 sense | B cccGGGAGGucucGuAGAcTT B | 1629 |
| 0 | CCCCGGGAGGUCUCGUAGACCGU | 1610 | 31703 | HCVa: 327U21 siNA stab07 sense | B ccGGGAGGucucGuAGAccTT B | 1630 |
| 0 | CCCGGGAGGUCUCGUAGACCGUG | 1611 | 31704 | HCVa: 328U21 siNA stab07 sense | B cGGGAGGucucGuAGAccGTT B | 1631 |
| 0 | CCGGGAGGUCUCGUAGACCGUGC | 1612 | 31705 | HCVa: 329U21 siNA stab07 sense | B GGGAGGucucGuAGAccGuTT B | 1632 |
| 0 | GCCCCGGGAGGUCUCGUAGACCG | 1609 | 31706 | HCVa: 344L21 siNA (326C) stab08 antisense | GucuAcGAGAccucccGGGTsT | 1633 |
| 0 | CCCCGGGAGGUCUCGUAGACCGU | 1610 | 31707 | HCVa: 345L21 siNA (327C) stab08 antisense | GGucuAcGAGAccucccGGTsT | 1634 |
| 0 | CCCGGGAGGUCUCGUAGACCGUG | 1611 | 31708 | HCVa: 346L21 siNA (328C) stab08 antisense | cGGucuAcGAGAccucccGTsT | 1635 |
| 0 | CCGGGAGGUCUCGUAGACCGUGC | 1612 | 31709 | HCVa: 347L21 siNA (329C) stab08 antisense | AcGGucuAcGAGAccucccTsT | 1636 |
| 0 | GCCCCGGGAGGUCUCGUAGACCG | 1609 | 31710 | HCVa: 326U21 siNA inv stab07 sense | B cAGAuGcucuGGAGGGcccTT B | 1637 |
| 0 | CCCCGGGAGGUCUCGUAGACCGU | 1610 | 31711 | HCVa: 327U21 siNA inv stab07 sense | B ccAGAuGcucuGGAGGGccTT B | 1638 |
| 0 | CCCGGGAGGUCUCGUAGACCGUG | 1611 | 31712 | HCVa: 328U21 siNA inv stab07 sense | B GccAGAuGcucuGGAGGGcTT B | 1639 |
| 0 | CCGGGAGGUCUCGUAGACCGUGC | 1612 | 31713 | HCVa: 329U21 siNA inv stab07 sense | B uGccAGAuGcucuGGAGGGTT B | 1640 |
| 0 | GCCCCGGGAGGUCUCGUAGACCG | 1609 | 31714 | HCVa: 344L21 siNA (326C) inv stab08 antisense | GGGcccuccAGAGcAucuGTsT | 1641 |
| 0 | CCCCGGGAGGUCUCGUAGACCGU | 1610 | 31715 | HCVa: 345L21 siNA (327C) inv stab08 antisense | GGcccuccAGAGcAucuGGTsT | 1642 |
| 0 | CCCGGGAGGUCUCGUAGACCGUG | 1611 | 31716 | HCVa: 346L21 siNA (328C) inv stab08 antisense | GcccuccAGAGcAucuGGcTsT | 1643 |
| 0 | CCGGGAGGUCUCGUAGACCGUGC | 1612 | 31717 | HCVa: 347L21 siNA (329C) inv stab08 antisense | cccuccAGAGcAucuGGcATsT | 1644 |
| 0 | GCCUUGUGGUACUGCCUGAUAGG | 1403 | 31762 | HCVa: 291U21 siNA stab08 sense | cuuGuGGuAcuGccuGAuATsT | 1645 |
| 0 | UGUGGUACUGCCUGAUAGGGUGC | 1404 | 31763 | HCVa: 295U21 siNA stab08 sense | uGGuAcuGccuGAuAGGGuTsT | 1646 |
| 0 | UGCCCCGGGAGGUCUCGUAGACC | 1394 | 31764 | HCVa: 325U21 siNA stab08 sense | ccccGGGAGGucucGuAGATsT | 1647 |
| 0 | GCCUUGUGGUACUGCCUGAUAGG | 1403 | 31765 | HCVa: 291U21 siNA inv stab08 sense | AuAGuccGucAuGGuGuucTsT | 1648 |
| 0 | UGUGGUACUGCCUGAUAGGGUGC | 1404 | 31766 | HCVa: 295U21 siNA inv stab08 sense | uGGGAuAGuccGucAuGGuTsT | 1649 |
| 0 | UGCCCCGGGAGGUCUCGUAGACC | 1394 | 31767 | HCVa: 325U21 siNA inv stab08 sense | AGAuGcucuGGAGGGccccTsT | 1650 |

TABLE III-continued

HCV Synthetic Modified siNA constructs

| Target Pos | Target | Seq ID | Compound # | Aliases | Sequence | Seq ID |
|---|---|---|---|---|---|---|
| 0 | CCGGGAGGUCUCGUAGACCGUGC | 1612 | 31709 | HCVa: 347L21 siNA (329C) stab08 antisense | AcGGucuAcGAGAccucccTsT | 1636 |
| 0 | CCCCGGGAGGUCUCGUAGACCGU | 1610 | 31928 | HCVa: 327U21 siNA stab08 sense | ccGGGAGGucucGuAGAccTsT | 1651 |
| 0 | CCCCGGGAGGUCUCGUAGACCGU | 1610 | 31929 | HCVa: 327U21 siNA inv stab08 sense | ccAGAuGcucuGGAGGGccTsT | 1652 |
| 0 | CCCGGGAGGUCUCGUAGACGGUG | 1611 | 31930 | HCVa: 328U21 siNA stab08 sense | cGGGAGGucucGuAGAccGTsT | 1653 |
| 0 | CCCGGGAGGUCUCGUAGACCGUG | 1611 | 31931 | HCVa: 328U21 siNA inv stab08 sense | GccAGAuGcucuGGAGGGcTsT | 1654 |
| 0 | CCCCGGGAGGUCUCGUAGACCGU | 1610 | 32007 | HCVa: 327U21 siNA stab08 + 5' abasic sense | B ccGGGAGGucucGuAGAccTsT | 1655 |
| 0 | CCCCGGGAGGUCUCGUAGACCGU | 1610 | 32008 | HCVa: 327U21 siNA stab08 + 3' abasic sense | ccGGGAGGucucGuAGAccTsT B | 1656 |
| 0 | CCCCGGGAGGUCUCGUAGACCGU | 1610 | 32009 | HCVa: 327U21 siNA stab08 + 5' & 3' abasic sense | B ccGGGAGGucucGuAGAccTsT B | 1657 |
| 0 | CCCCGGGAGGUCUCGUAGACCGU | 1610 | 32174 | HCVa: 327 siNA 3'-classI 10 bp | UCUCGUAGACCUUGGUCUACGAGAC CUCCCGGTT | 1658 |
| 0 | CCCCGGGAGGUCUCGUAGACCGU | 1610 | 32175 | HCVa: 327 siNA 3'-classI 8 bp | UCGUAGACCUUGGUCUACGAGACCU CCCGGTT | 1659 |
| 0 | CCCCGGGAGGUCUCGUAGACCGU | 1610 | 32176 | HCVa: 327 siNA 3'-classI 6 bp | GUAGACCUUGGUCUACGAGACCUCC CGGTT | 1660 |
| 0 | CCCCGGGAGGUCUCGUAGACCGU | 1610 | 32177 | HCVa: 327 siNA 3'-classI 4 bp | AGACCUUGGUCUACGAGACGUCGCG GTT | 1661 |
| 0 | CCCCGGGAGGUCUCGUAGACCGU | 1610 | 32178 | HCVa: 327 siNA 5'-classI 10 bp | GGUCUACGAGACCUCCCGGUUCCGG GAGGUCU | 1662 |
| 0 | CCCCGGGAGGUCUCGUAGAGCGU | 1610 | 32179 | HCVa: 327 siNA 5'-classI 8 bp | GGUCUACGAGACCUCCCGGUUCCGG GAGGU | 1663 |
| 0 | CCCCGGGAGGUCUGGUAGACCGU | 1610 | 32180 | HCVa: 327 siNA 5'-classI 6 bp | GGUCUACGAGACCUCCCGGUUGCGG GAG | 1664 |
| 0 | CCCCGGGAGGUCUCGUAGACCGU | 1610 | 32181 | HCVa: 327 siNA 5'-classI 4 bp | GGUCUACGAGACGUCCCGGUUCCGG G | 1665 |
| 0 | CCCCGGGAGGUCUCGUAGACCGU | 1610 | 32182 | HCVa: 327 siNA 3'-gaaa 10 bp | CUCGUAGACC GAAAGGUCUACGAG ACCUCCCGGTT | 1666 |
| 0 | CCCCGGGAGGUCUCGUAGACCGU | 1610 | 32183 | HCVa: 327 siNA 3-gaaa 8 bp | CGUAGACC GAAAGGUCUACGAGAC CUCCCGGTT | 1667 |
| 0 | CCCCGGGAGGUCUCGUAGACCGU | 1610 | 32184 | HCVa: 327 siNA 3'-gaaa 6 bp | UAGACC GAAAGGUCUACGAGACCU CCCGGTT | 1668 |
| 0 | CCCCGGGAGGUCUCGUAGACCGU | 1610 | 32185 | HCVa: 327 siNA 3'-gaaa 4 bp | GACC GAAAGGUCUACGAGACCUCC CGGTT | 1669 |
| 0 | CCCCGGGAGGUCUCGUAGACCGU | 1610 | 32186 | HCVa: 327 siNA 5'-gaaa 10 bp | GGUCUACGAGACCUCCCGGUU GAA ACCGGGAGGUC | 1670 |
| 0 | CCCCGGGAGGUCUCGUAGACCGU | 1610 | 32187 | HCVa: 327 siNA 5'-gaaa 8 bp | GGUCUACGAGACCUCCCGGUU GAA ACCGGGAGG | 1671 |
| 0 | CCCCGGGAGGUCUCGUAGACCGU | 1610 | 32188 | HCVa: 327 siNA 5'-gaaa 6 bp | GGUCUACGAGACCUCCCGGUU GAA ACCGGGA | 1672 |
| 0 | CCCCGGGAGGUCUCGUAGACCGU | 1610 | 32189 | HCVa: 327 siNA 5'-gaaa 4 bp | GGUCUACGAGACCUCCCGGUU GAA ACCGG | 1673 |
| 0 | CCCCGGGAGGUCUCGUAGACCGU | 1610 | 32190 | HCVa: 327 siNA 3'-uuuguguag 10 bp | CGUAGACCUU UUUGUGUAGGGUCU ACGAGACCUCCCGGTT | 1674 |

TABLE III-continued

HCV Synthetic Modified siNA constructs

| Target Pos | Target | Seq ID | Compound # | Aliases | | Sequence | Seq ID |
|---|---|---|---|---|---|---|---|
| 0 | CCCCGGGAGGUGUCGUAGACCGU | 1610 | 32191 | HCVa: 327 8 bp | siNA 3'-uuuguguag | UAGACCUU UUUGUGUAGGGUCUAC GAGACCUCCCGGTT | 1675 |
| 0 | CCCCGGGAGGUCUCGUAGACCGU | 1610 | 32192 | HCVa: 327 6 bp | siNA 3'-uuuguguag | GACCUU UUUGUGUAGGGUCUACGA GACCUCCCGGTT | 1676 |
| 0 | CCCCGGGAGGUCUCGUAGACCGU | 1610 | 32193 | HCVa: 327 4 bp | siNA 3'-uuuguguag | CCUU UUUGUGUAGGGUCUACGAGA CCUCCCGGTT | 1677 |
| 0 | CCCCGGGAGGUCUCGUAGACCGU | 1610 | 32194 | HCVa: 327 10 bp | siNA 5'-uuuguguag | GGUCUACGAGACCUCCCGGUUUUUG UGUAG CCGGGAGGUC | 1678 |
| 0 | CCCCGGGAGGUGUCGUAGACCGU | 1610 | 32195 | HCVa: 327 8 bp | siNA 5'-uuuguguag | GGUCUACGAGACCUCCCGGUUUUUG UGUAG CCGGGAGG | 1679 |
| 0 | CCCCGGGAGGUCUCGUAGACCGU | 1610 | 32196 | HCVa: 327 6 bp | siNA 5'-uuuguguag | GGUCUACGAGACCUGCGGGUUUUUG UGUAG GGGGGA | 1680 |
| 0 | CCCCGGGAGGUCUCGUAGACCGU | 1610 | 32197 | HCVa: 327 4 bp | siNA 5'-uuuguguag | GGUCUACGAGACCUCCCGGUUUUUG UGUAG CCGG | 1681 |

Uppercase = ribonucleotide
u, c = 2'-deoxy-2'-fluoro U, C
T = thymidine
B = inverted deoxy abasic
s = phosphorothioate linkage
A = deoxy Adenosine
G = deoxy Guanosine
A = 2'-O-methyl Adenosine
G = 2'-O-methyl Guanosine
X = universal base (5-nitroindole)
Z = universal base (3-nitropyrrole)

TABLE IV

Non-limiting examples of Stabilization Chemistries for chemically modified siNA constructs

| Chemistry | pyrimidine | Purine | cap | p = S | Strand |
|---|---|---|---|---|---|
| "Stab 1" | Ribo | Ribo | — | 5 at 5'-end 1 at 3'-end | S/AS |
| "Stab 2" | Ribo | Ribo | — | All linkages | Usually AS |
| "Stab 3" | 2'-fluoro | Ribo | — | 4 at 5'-end 4 at 3'-end | Usually S |
| "Stab 4" | 2'-fluoro | Ribo | 5' and 3'-ends | — | Usually S |
| "Stab 5" | 2'-fluoro | Ribo | — | 1 at 3'-end | Usually AS |
| "Stab 6" | 2'-O-Methyl | Ribo | 5' and 3'-ends | — | Usually S |
| "Stab 7" | 2'-fluoro | 2'-deoxy | 5' and 3'-ends | — | Usually S |
| "Stab 8" | 2'-fluoro | 2'-O-Methyl | — | 1 at 3'-end | Usually AS |
| "Stab 9" | Ribo | Ribo | 5' and 3'-ends | — | Usually S |
| "Stab 10" | Ribo | Ribo | — | 1 at 3'-end | Usually AS |
| "Stab 11" | 2'-fluoro | 2'-deoxy | — | 1 at 3'-end | Usually AS |
| "Stab 12" | 2'-fluoro | LNA | 5' and 3'-ends | — | Usually S |
| "Stab 13" | 2'-fluoro | LNA | | 1 at 3'-end | Usually AS |
| "Stab 14" | 2'-fluoro | 2'-deoxy | | 2 at 5'-end 1 at 3'-end | Usually AS |
| "Stab 15" | 2'-deoxy | 2'-deoxy | | 2 at 5'-end 1 at 3'-end | Usually AS |
| "Stab 16" | Ribo | 2'-O-Methyl | 5' and 3'-ends | | Usually S |
| "Stab 17" | 2'-O-Methyl | 2'-O-Methyl | 5' and 3'-ends | | Usually S |
| "Stab 18" | 2'-fluoro | 2'-O-Methyl | 5' and 3'-ends | 1 at 3'-end | Usually S |
| "Stab 19" | Ribo | Ribo | TT at 3'-ends | | S/AS |
| "Stab 20" | Ribo | Ribo | TT at 3'-ends | 1 at 3'-end | S/AS |

CAP = any terminal cap, see for example FIG. 10.
All Stab 1-20 chemistries can comprise 3'-terminal thymidine (TT) residues
All Stab 1-20 chemistries typically comprise 21 nucleotides, but can vary as described herein.
S = sense strand
AS = antisense strand

TABLE V

| Reagent | Equivalents | Amount | Wait Time* DNA | Wait Time* 2'-O-methyl | Wait Time* RNA |
|---|---|---|---|---|---|
| A. 2.5 μmol Synthesis Cycle ABI 394 Instrument | | | | | |
| Phosphoramidites | 6.5 | 163 μL | 45 sec | 2.5 min | 7.5 min |
| S-Ethyl Tetrazole | 23.8 | 238 μL | 45 sec | 2.5 min | 7.5 min |

TABLE V-continued

| | | | | | |
|---|---|---|---|---|---|
| Acetic Anhydride | 100 | 233 µL | 5 sec | 5 sec | 5 sec |
| N-Methyl Imidazole | 186 | 233 µL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 µL | 100 sec | 300 sec | 300 sec |
| Acetonitrile | NA | 6.67 mL | NA | NA | NA |

B. 0.2 µmol Synthesis Cycle ABI 394 Instrument

| | | | | | |
|---|---|---|---|---|---|
| Phosphoramidites | 15 | 31 µL | 45 sec | 233 sec | 465 sec |
| S-Ethyl Tetrazole | 38.7 | 31 µL | 45 sec | 233 min | 465 sec |
| Acetic Anhydride | 655 | 124 µL | 5 sec | 5 sec | 5 sec |
| N-Methyl Imidazole | 1245 | 124 µL | 5 sec | 5 sec | 5 sec |
| TCA | 700 | 732 µL | 10 sec | 10 sec | 10 sec |
| Iodine | 20.6 | 244 µL | 15 sec | 15 sec | 15 sec |
| Beaucage | 7.7 | 232 µL | 100 sec | 300 sec | 300 sec |
| Acetonitrile | NA | 2.64 mL | NA | NA | NA |

C. 0.2 µmol Synthesis Cycle 96 well Instrument

| Reagent | Equivalents: DNA/ 2'-O-methyl/Ribo | Amount: DNA/2'-O-methyl/Ribo | Wait Time* DNA | Wait Time* 2'-O-methyl | Wait Time* Ribo |
|---|---|---|---|---|---|
| Phosphoramidites | 22/33/66 | 40/60/120 µL | 60 sec | 180 sec | 360 sec |
| S-Ethyl Tetrazole | 70/105/210 | 40/60/120 µL | 60 sec | 180 min | 360 sec |
| Acetic Anhydride | 265/265/265 | 50/50/50 µL | 10 sec | 10 sec | 10 sec |
| N-Methyl Imidazole | 502/502/502 | 50/50/50 µL | 10 sec | 10 sec | 10 sec |
| TCA | 238/475/475 | 250/500/500 µL | 15 sec | 15 sec | 15 sec |
| Iodine | 6.8/6.8/6.8 | 80/80/80 µL | 30 sec | 30 sec | 30 sec |
| Beaucage | 34/51/51 | 80/120/120 | 100 sec | 200 sec | 200 sec |
| Acetonitrile | NA | 1150/1150/1150 µL | NA | NA | NA |

*Wait time does not include contact time during delivery.
*Tandem synthesis utilizes double coupling of linker molecule

SEQUENCE LISTING (1706 sequences)

SEQ ID NO: 1 - RNA, 19 nt, Artificial Sequence
  Synthetic Target Sequence/siNA sense region
gccccgggaggucucguag

SEQ ID NO: 2 - RNA, 19 nt, Artificial Sequence
  Synthetic Target Sequence/siNA sense region
ugugguacugccugauagg

SEQ ID NO: 3 - RNA, 19 nt, Artificial Sequence
  Synthetic Target Sequence/siNA sense region
uugugguacugccugauag

SEQ ID NO: 4 - RNA, 19 nt, Artificial Sequence
  Synthetic Target Sequence/siNA sense region
ccccgggaggucucguaga

SEQ ID NO: 5 - RNA, 19 nt, Artificial Sequence
  Synthetic Target Sequence/siNA sense region
gugguacugccugauaggg

SEQ ID NO: 6 - RNA, 19 nt, Artificial Sequence
  Synthetic Target Sequence/siNA sense region
cugccugauagggugcuug

SEQ ID NO: 7 - RNA, 19 nt, Artificial Sequence
  Synthetic Target Sequence/siNA sense region
ccuugugguacugccugau

SEQ ID NO: 8 - RNA, 19 nt, Artificial Sequence
  Synthetic Target Sequence/siNA sense region
gcgaaaggccuugugguac

SEQ ID NO: 9 - RNA, 19 nt, Artificial Sequence
  Synthetic Target Sequence/siNA sense region
uacugccugauagggugcu

SEQ ID NO: 10 - RNA, 19 nt, Artificial Sequence
  Synthetic Target Sequence/siNA sense region
gguacugccugauagggug

SEQ ID NO: 11 - RNA, 19 nt, Artificial Sequence
  Synthetic Target Sequence/siNA sense region
aaaggccuugugguacugc

SEQ ID NO: 12 - RNA, 19 nt, Artificial Sequence
  Synthetic Target Sequence/siNA sense region
aaggccuugugguacugcc

SEQ ID NO: 13 - RNA, 19 nt, Artificial Sequence
  Synthetic Target Sequence/siNA sense region
cuugugguacugccugaua

SEQ ID NO: 14 - RNA, 19 nt, Artificial Sequence
  Synthetic Target Sequence/siNA sense region
aggccuugugguacugccu

SEQ ID NO: 15 - RNA, 19 nt, Artificial Sequence
  Synthetic Target Sequence/siNA sense region
guacugccugauagggugc

SEQ ID NO: 16 - RNA, 19 nt, Artificial Sequence
  Synthetic Target Sequence/siNA sense region
acugccugauagggugcuu

SEQ ID NO: 17 - RNA, 19 nt, Artificial Sequence
  Synthetic Target Sequence/siNA sense region
cuugcgagugccccgggag

SEQ ID NO: 18 - RNA, 19 nt, Artificial Sequence
  Synthetic Target Sequence/siNA sense region
cugauagggugcuugcgag

SEQ ID NO: 19 - RNA, 19 nt, Artificial Sequence
  Synthetic Target Sequence/siNA sense region
uugcgagugccccgggagg

SEQ ID NO: 20 - RNA, 19 nt, Artificial Sequence
  Synthetic Target Sequence/siNA sense region
ccugauagggugcuugcga

SEQ ID NO: 21 - RNA, 19 nt, Artificial Sequence
  Synthetic Target Sequence/siNA sense region
ggccuugugguacugccug

SEQ ID NO: 22 - RNA, 19 nt, Artificial Sequence
  Synthetic Target Sequence/siNA sense region
gcuugcgagugccccggga

SEQ ID NO: 23 - RNA, 19 nt, Artificial Sequence
  Synthetic Target Sequence/siNA sense region
ugccugauagggugcuugc

SEQ ID NO: 24 - RNA, 19 nt, Artificial Sequence
  Synthetic Target Sequence/siNA sense region
gaaaggccuugugguacug

SEQ ID NO: 25 - RNA, 19 nt, Artificial Sequence
  Synthetic Target Sequence/siNA sense region
gccugauagggugcuugcg

SEQ ID NO: 26 - RNA, 19 nt, Artificial Sequence
  Synthetic Target Sequence/siNA sense region
cgaaaggccuugugguacu

SEQ ID NO: 27 - RNA, 19 nt, Artificial Sequence
  Synthetic Target Sequence/siNA sense region
gccuugugguacugccuga

SEQ ID NO: 28 - RNA, 19 nt, Artificial Sequence
  Synthetic Target Sequence/siNA sense region
gagugccccgggaggucuc

SEQ ID NO: 29 - RNA, 19 nt, Artificial Sequence
  Synthetic Target Sequence/siNA sense region
cccgggaggucucguagac

SEQ ID NO: 30 - RNA, 19 nt, Artificial Sequence
  Synthetic Target Sequence/siNA sense region
ugcgagugccccgggaggu

SEQ ID NO: 31 - RNA, 19 nt, Artificial Sequence
  Synthetic Target Sequence/siNA sense region
ugguacugccugauagggu

SEQ ID NO: 32 - RNA, 19 nt, Artificial Sequence
  Synthetic Target Sequence/siNA sense region
ccggugaguacaccggaau

SEQ ID NO: 33 - RNA, 19 nt, Artificial Sequence
  Synthetic Target Sequence/siNA sense region
gcgagugccccgggagguc

SEQ ID NO: 34 - RNA, 19 nt, Artificial Sequence
  Synthetic Target Sequence/siNA sense region
cgagugccccgggaggucu

SEQ ID NO: 35 - RNA, 19 nt, Artificial Sequence
  Synthetic Target Sequence/siNA sense region
ugccccgggaggucucgua

SEQ ID NO: 36 - RNA, 19 nt, Artificial Sequence
  Synthetic Target Sequence/siNA sense region
gugccccgggaggucucgu

SEQ ID NO: 37 - RNA, 19 nt, Artificial Sequence
  Synthetic Target Sequence/siNA sense region
agugccccgggaggucucg

SEQ ID NO: 38 - RNA, 19 nt, Artificial Sequence
  Synthetic Target Sequence/siNA sense region
ccgggaggucucguagacc

SEQ ID NO: 39 - RNA, 19 nt, Artificial Sequence
  Synthetic Target Sequence/siNA sense region
ugauagggugcuugcgagu

SEQ ID NO: 40 - RNA, 19 nt, Artificial Sequence
  Synthetic Target Sequence/siNA sense region
gugcuugcgagugccccgg

SEQ ID NO: 41 - RNA, 19 nt, Artificial Sequence
  Synthetic Target Sequence/siNA sense region
auagggugcuugcgagugc

SEQ ID NO: 42 - RNA, 19 nt, Artificial Sequence
  Synthetic Target Sequence/siNA sense region
gggugcuugcgagugcccc

SEQ ID NO: 43 - RNA, 19 nt, Artificial Sequence
  Synthetic Target Sequence/siNA sense region
cgggaggucucguagaccg

SEQ ID NO: 44 - RNA, 19 nt, Artificial Sequence
  Synthetic Target Sequence/siNA sense region
gggaggucucguagaccgu

SEQ ID NO: 45 - RNA, 19 nt, Artificial Sequence
  Synthetic Target Sequence/siNA sense region
gauagggugcuugcgagug

SEQ ID NO: 46 - RNA, 19 nt, Artificial Sequence
  Synthetic Target Sequence/siNA sense region
ggaggucucguagaccgug

SEQ ID NO: 47 - RNA, 19 nt, Artificial Sequence
  Synthetic Target Sequence/siNA sense region
agggugcuugcgagugccc

SEQ ID NO: 48 - RNA, 19 nt, Artificial Sequence
  Synthetic Target Sequence/siNA sense region
ugcuugcgagugccccggg

SEQ ID NO: 49 - RNA, 19 nt, Artificial Sequence
  Synthetic Target Sequence/siNA sense region
ggugcuugcgagugccccg

SEQ ID NO: 50 - RNA, 19 nt, Artificial Sequence
  Synthetic Target Sequence/siNA sense region
uagggugcuugcgagugcc

SEQ ID NO: 51 - RNA, 19 nt, Artificial Sequence
  Synthetic Target Sequence/siNA sense region
aggucucguagaccgugca

SEQ ID NO: 52 - RNA, 19 nt, Artificial Sequence
  Synthetic Target Sequence/siNA sense region
gaggucucguagaccgugc

SEQ ID NO: 53 - RNA, 19 nt, Artificial Sequence
  Synthetic Target Sequence/siNA sense region
ggaaccggugaguacaccg

SEQ ID NO: 54 - RNA, 19 nt, Artificial Sequence
  Synthetic Target Sequence/siNA sense region
cggaaccggugaguacacc

SEQ ID NO: 55 - RNA, 19 nt, Artificial Sequence
  Synthetic Target Sequence/siNA sense region
cggugaguacaccggaauu

SEQ ID NO: 56 - RNA, 19 nt, Artificial Sequence
  Synthetic Target Sequence/siNA sense region
gcggaaccggugaguacac

SEQ ID NO: 57 - RNA, 19 nt, Artificial Sequence
  Synthetic Target Sequence/siNA sense region
aaccggugaguacaccgga

SEQ ID NO: 58 - RNA, 19 nt, Artificial Sequence
  Synthetic Target Sequence/siNA sense region
accggugaguacaccggaa

SEQ ID NO: 59 - RNA, 19 nt, Artificial Sequence
  Synthetic Target Sequence/siNA sense region
cugcggaaccggugaguac

SEQ ID NO: 60 - RNA, 19 nt, Artificial Sequence
  Synthetic Target Sequence/siNA sense region
gucugcggaaccggugagu

SEQ ID NO: 61 - RNA, 19 nt, Artificial Sequence
  Synthetic Target Sequence/siNA sense region
gaaccggugaguacaccgg

SEQ ID NO: 62 - RNA, 19 nt, Artificial Sequence
  Synthetic Target Sequence/siNA sense region
ugcggaaccggugaguaca

SEQ ID NO: 63 - RNA, 19 nt, Artificial Sequence
  Synthetic Target Sequence/siNA sense region
ucugcggaaccggugagua

SEQ ID NO: 64 - RNA, 19 nt, Artificial Sequence
  Synthetic Target Sequence/siNA sense region
gggagagccauaguggucu

SEQ ID NO: 65 - RNA, 19 nt, Artificial Sequence
  Synthetic Target Sequence/siNA sense region
guggucugcggaaccggug

SEQ ID NO: 66 - RNA, 19 nt, Artificial Sequence
  Synthetic Target Sequence/siNA sense region
ggucugcggaaccggugag

SEQ ID NO: 67 - RNA, 19 nt, Artificial Sequence
  Synthetic Target Sequence/siNA sense region
cgggagagccauagugguc

SEQ ID NO: 68 - RNA, 19 nt, Artificial Sequence
  Synthetic Target Sequence/siNA sense region
ccgggagagccauaguggu

SEQ ID NO: 69 - RNA, 19 nt, Artificial Sequence
  Synthetic Target Sequence/siNA sense region
uggucugcggaaccgguga

SEQ ID NO: 70 - RNA, 19 nt, Artificial Sequence
  Synthetic Target Sequence/siNA sense region
gugaguacaccggaauugc

SEQ ID NO: 71 - RNA, 19 nt, Artificial Sequence
  Synthetic Target Sequence/siNA sense region
ugaguacaccggaauugcc

SEQ ID NO: 72 - RNA, 19 nt, Artificial Sequence
  Synthetic Target Sequence/siNA sense region
ggugaguacaccggaauug

SEQ ID NO: 73 - RNA, 19 nt, Artificial Sequence
  Synthetic Target Sequence/siNA sense region
gagccauaguggucugcgg

SEQ ID NO: 74 - RNA, 19 nt, Artificial Sequence
  Synthetic Target Sequence/siNA sense region
agagccauaguggucugcg

SEQ ID NO: 75 - RNA, 19 nt, Artificial Sequence
  Synthetic Target Sequence/siNA sense region
uaguggucugcggaaccgg

SEQ ID NO: 76 - RNA, 19 nt, Artificial Sequence
  Synthetic Target Sequence/siNA sense region
auaguggucugcggaaccg

SEQ ID NO: 77 - RNA, 19 nt, Artificial Sequence
  Synthetic Target Sequence/siNA sense region
gagagccauaguggucugc

SEQ ID NO: 78 - RNA, 19 nt, Artificial Sequence
  Synthetic Target Sequence/siNA sense region
gccauaguggucugcggaa

SEQ ID NO: 79 - RNA, 19 nt, Artificial Sequence
  Synthetic Target Sequence/siNA sense region
aguggucugcggaaccggu

SEQ ID NO: 80 - RNA, 19 nt, Artificial Sequence
  Synthetic Target Sequence/siNA sense region
cauaguggucugcggaacc

SEQ ID NO: 81 - RNA, 19 nt, Artificial Sequence
  Synthetic Target Sequence/siNA sense region
agccauaguggucugcgga

SEQ ID NO: 82 - RNA, 19 nt, Artificial Sequence
  Synthetic Target Sequence/siNA sense region
ccauaguggucugcggaac

SEQ ID NO: 83 - RNA, 19 nt, Artificial Sequence
  Synthetic Target Sequence/siNA sense region
ccccucccgggagagccau

SEQ ID NO: 84 - RNA, 19 nt, Artificial Sequence
  Synthetic Target Sequence/siNA sense region
ggagagccauaguggucug

SEQ ID NO: 85 - RNA, 19 nt, Artificial Sequence
  Synthetic Target Sequence/siNA sense region
cccgggagagccauagugg

SEQ ID NO: 86 - RNA, 19 nt, Artificial Sequence
  Synthetic Target Sequence/siNA sense region
cccccucccgggagagcca

SEQ ID NO: 87 - RNA, 19 nt, Artificial Sequence
  Synthetic Target Sequence/siNA sense region
ucccgggagagccauagug

SEQ ID NO: 88 - RNA, 19 nt, Artificial Sequence
  Synthetic Target Sequence/siNA sense region
ccccccucccgggagagcc

SEQ ID NO: 89 - RNA, 19 nt, Artificial Sequence
  Synthetic Target Sequence/siNA sense region
cccucccgggagagccaua

SEQ ID NO: 90 - RNA, 19 nt, Artificial Sequence
  Synthetic Target Sequence/siNA sense region
ccucccgggagagccauag

SEQ ID NO: 91 - RNA, 19 nt, Artificial Sequence
  Synthetic Target Sequence/siNA sense region
cucccgggagagccauagu

SEQ ID NO: 92 - RNA, 19 nt, Artificial Sequence
  Synthetic Target Sequence/siNA sense region
uguugccgcgcaggggccc

SEQ ID NO: 93 - RNA, 19 nt, Artificial Sequence
  Synthetic Target Sequence/siNA sense region
cccccccucccgggagagc

SEQ ID NO: 94 - RNA, 19 nt, Artificial Sequence
  Synthetic Target Sequence/siNA sense region
cauggcguuaguaugagug

SEQ ID NO: 95 - RNA, 19 nt, Artificial Sequence
  Synthetic Target Sequence/siNA sense region
uagccauggcguuaguaug

SEQ ID NO: 96 - RNA, 19 nt, Artificial Sequence
  Synthetic Target Sequence/siNA sense region
agccauggcguuaguauga

SEQ ID NO: 97 - RNA, 19 nt, Artificial Sequence
  Synthetic Target Sequence/siNA sense region
ccauggcguuaguaugagu

SEQ ID NO: 98 - RNA, 19 nt, Artificial Sequence
  Synthetic Target Sequence/siNA sense region
auggcguuaguaugagugu

SEQ ID NO: 99 - RNA, 19 nt, Artificial Sequence
  Synthetic Target Sequence/siNA sense region
aagcgucuagccauggcgu

SEQ ID NO: 100 - RNA, 19 nt, Artificial Sequence
  Synthetic Target Sequence/siNA sense region
gucuagccauggcguuagu

SEQ ID NO: 101 - RNA, 19 nt, Artificial Sequence
  Synthetic Target Sequence/siNA sense region
aaagcgucuagccauggcg

SEQ ID NO: 102 - RNA, 19 nt, Artificial Sequence
  Synthetic Target Sequence/siNA sense region
gcgucuagccauggcguua

SEQ ID NO: 103 - RNA, 19 nt, Artificial Sequence
  Synthetic Target Sequence/siNA sense region
gccauggcguuaguaugag

SEQ ID NO: 104 - RNA, 19 nt, Artificial Sequence
  Synthetic Target Sequence/siNA sense region
agcgucuagccauggcguu

SEQ ID NO: 105 - RNA, 19 nt, Artificial Sequence
  Synthetic Target Sequence/siNA sense region
cgucuagccauggcguuag

SEQ ID NO: 106 - RNA, 19 nt, Artificial Sequence
  Synthetic Target Sequence/siNA sense region
ucuagccauggcguuagua

SEQ ID NO: 107 - RNA, 19 nt, Artificial Sequence
  Synthetic Target Sequence/siNA sense region
gaaagcgucuagccauggc

SEQ ID NO: 108 - RNA, 19 nt, Artificial Sequence
  Synthetic Target Sequence/siNA sense region
cuagccauggcguuaguau

SEQ ID NO: 109 - RNA, 19 nt, Artificial Sequence
  Synthetic Target Sequence/siNA sense region
cacuccccugugaggaacu

SEQ ID NO: 110 - RNA, 19 nt, Artificial Sequence
  Synthetic Target Sequence/siNA sense region
accucaaagaaaaaccaaa

SEQ ID NO: 111 - RNA, 19 nt, Artificial Sequence
  Synthetic Target Sequence/siNA sense region
cgcagaaagcgucuagcca

SEQ ID NO: 112 - RNA, 19 nt, Artificial Sequence
  Synthetic Target Sequence/siNA sense region
ggguaaggucaucgauacc

SEQ ID NO: 113 - RNA, 19 nt, Artificial Sequence
  Synthetic Target Sequence/siNA sense region
cagaaagcgucuagccaug

SEQ ID NO: 114 - RNA, 19 nt, Artificial Sequence
  Synthetic Target Sequence/siNA sense region
aaaccucaaagaaaaacca

SEQ ID NO: 115 - RNA, 19 nt, Artificial Sequence
  Synthetic Target Sequence/siNA sense region
gcagaaagcgucuagccau

SEQ ID NO: 116 - RNA, 19 nt, Artificial Sequence
  Synthetic Target Sequence/siNA sense region
agaaagcgucuagccaugg

SEQ ID NO: 117 - RNA, 19 nt, Artificial Sequence
  Synthetic Target Sequence/siNA sense region
acgcagaaagcgucuagcc

SEQ ID NO: 118 - RNA, 19 nt, Artificial Sequence
  Synthetic Target Sequence/siNA sense region
aaccucaaagaaaaaccaa

SEQ ID NO: 119 - RNA, 19 nt, Artificial Sequence
  Synthetic Target Sequence/siNA sense region
uggguaaggucaucgauac

SEQ ID NO: 120 - RNA, 19 nt, Artificial Sequence
  Synthetic Target Sequence/siNA sense region
guaaggucaucgauacccu

SEQ ID NO: 121 - RNA, 19 nt, Artificial Sequence
  Synthetic Target Sequence/siNA sense region
uucacgcagaaagcgucua

SEQ ID NO: 122 - RNA, 19 nt, Artificial Sequence
  Synthetic Target Sequence/siNA sense region
gguaaggucaucgauaccc

SEQ ID NO: 123 - RNA, 19 nt, Artificial Sequence
  Synthetic Target Sequence/siNA sense region
aucacuccccugugaggaa

SEQ ID NO: 124 - RNA, 19 nt, Artificial Sequence
  Synthetic Target Sequence/siNA sense region
ucacuccccugugaggaac

SEQ ID NO: 125 - RNA, 19 nt, Artificial Sequence
  Synthetic Target Sequence/siNA sense region
ugucuucacgcagaaagcg

SEQ ID NO: 126 - RNA, 19 nt, Artificial Sequence
  Synthetic Target Sequence/siNA sense region
ucacgcagaaagcgucuag

SEQ ID NO: 127 - RNA, 19 nt, Artificial Sequence
  Synthetic Target Sequence/siNA sense region
cacgcagaaagcgucuagc

SEQ ID NO: 128 - RNA, 19 nt, Artificial Sequence
  Synthetic Target Sequence/siNA sense region
gaccggguccuuucuugga

SEQ ID NO: 129 - RNA, 19 nt, Artificial Sequence
  Synthetic Target Sequence/siNA sense region
gaggaacuacugucuucac

SEQ ID NO: 130 - RNA, 19 nt, Artificial Sequence
  Synthetic Target Sequence/siNA sense region
cugugaggaacuacugucu

SEQ ID NO: 131 - RNA, 19 nt, Artificial Sequence
  Synthetic Target Sequence/siNA sense region
ggaacuacugucuucacgc

SEQ ID NO: 132 - RNA, 19 nt, Artificial Sequence
  Synthetic Target Sequence/siNA sense region
acuccccugugaggaacua

SEQ ID NO: 133 - RNA, 19 nt, Artificial Sequence
  Synthetic Target Sequence/siNA sense region
gucuucacgcagaaagcgu

SEQ ID NO: 134 - RNA, 19 nt, Artificial Sequence
  Synthetic Target Sequence/siNA sense region
aggaacuacugucuucacg

SEQ ID NO: 135 - RNA, 19 nt, Artificial Sequence
  Synthetic Target Sequence/siNA sense region
ccugugaggaacuacuguc

SEQ ID NO: 136 - RNA, 19 nt, Artificial Sequence
  Synthetic Target Sequence/siNA sense region
ugugaggaacuacugucuu

SEQ ID NO: 137 - RNA, 19 nt, Artificial Sequence
  Synthetic Target Sequence/siNA sense region
ucuucacgcagaaagcguc

SEQ ID NO: 138 - RNA, 19 nt, Artificial Sequence
  Synthetic Target Sequence/siNA sense region
gaacuacugucuucacgca

SEQ ID NO: 139 - RNA, 19 nt, Artificial Sequence
  Synthetic Target Sequence/siNA sense region
cccugugaggaacuacugu

SEQ ID NO: 140 - RNA, 19 nt, Artificial Sequence
  Synthetic Target Sequence/siNA sense region
cuucacgcagaaagcgucu

SEQ ID NO: 141 - RNA, 19 nt, Artificial Sequence
  Synthetic Target Sequence/siNA sense region
ugaggaacuacugucuuca

SEQ ID NO: 142 - RNA, 19 nt, Artificial Sequence
  Synthetic Target Sequence/siNA sense region
uggcguuaguaugaguguc

SEQ ID NO: 143 - RNA, 19 nt, Artificial Sequence
  Synthetic Target Sequence/siNA sense region
ccccugugaggaacuacug

SEQ ID NO: 144 - RNA, 19 nt, Artificial Sequence
  Synthetic Target Sequence/siNA sense region
gugaggaacuacugucuuc

SEQ ID NO: 145 - RNA, 19 nt, Artificial Sequence
  Synthetic Target Sequence/siNA sense region
ggcguuaguaugagugucg

SEQ ID NO: 146 - RNA, 19 nt, Artificial Sequence
  Synthetic Target Sequence/siNA sense region
gccgaguaguguugggucg

SEQ ID NO: 147 - RNA, 19 nt, Artificial Sequence
  Synthetic Target Sequence/siNA sense region
acugucuucacgcagaaag

SEQ ID NO: 148 - RNA, 19 nt, Artificial Sequence
  Synthetic Target Sequence/siNA sense region
ugggucgcgaaaggccuug

SEQ ID NO: 149 - RNA, 19 nt, Artificial Sequence
  Synthetic Target Sequence/siNA sense region
cuacugucuucacgcagaa

SEQ ID NO: 150 - RNA, 19 nt, Artificial Sequence
  Synthetic Target Sequence/siNA sense region
cgaguaguguugggucgcg

SEQ ID NO: 151 - RNA, 19 nt, Artificial Sequence
  Synthetic Target Sequence/siNA sense region
guaguguugggucgcgaaa

SEQ ID NO: 152 - RNA, 19 nt, Artificial Sequence
  Synthetic Target Sequence/siNA sense region
uaaaccucaaagaaaaacc

SEQ ID NO: 153 - RNA, 19 nt, Artificial Sequence
  Synthetic Target Sequence/siNA sense region
ccgaguaguguugggucgc

SEQ ID NO: 154 - RNA, 19 nt, Artificial Sequence
  Synthetic Target Sequence/siNA sense region
agccgaguaguguuggguc

SEQ ID NO: 155 - RNA, 19 nt, Artificial Sequence
  Synthetic Target Sequence/siNA sense region
gucgcgaaaggccuugugg

SEQ ID NO: 156 - RNA, 19 nt, Artificial Sequence
  Synthetic Target Sequence/siNA sense region
uaguguugggucgcgaaag

SEQ ID NO: 157 - RNA, 19 nt, Artificial Sequence
  Synthetic Target Sequence/siNA sense region
cuagccgaguaguguuggg

SEQ ID NO: 158 - RNA, 19 nt, Artificial Sequence
  Synthetic Target Sequence/siNA sense region
gaguaguguugggucgcga

SEQ ID NO: 159 - RNA, 19 nt, Artificial Sequence
  Synthetic Target Sequence/siNA sense region
ucgcgaaaggccuuguggu

SEQ ID NO: 160 - RNA, 19 nt, Artificial Sequence
  Synthetic Target Sequence/siNA sense region
gcguuaguaugagugucgu

SEQ ID NO: 161 - RNA, 19 nt, Artificial Sequence
  Synthetic Target Sequence/siNA sense region
uagccgaguaguguugggu

SEQ ID NO: 162 - RNA, 19 nt, Artificial Sequence
  Synthetic Target Sequence/siNA sense region
aacuacugucuucacgcag

SEQ ID NO: 163 - RNA, 19 nt, Artificial Sequence
  Synthetic Target Sequence/siNA sense region
cgcgaaaggccuuguggua

SEQ ID NO: 164 - RNA, 19 nt, Artificial Sequence
  Synthetic Target Sequence/siNA sense region
aguguugggucgcgaaagg

SEQ ID NO: 165 - RNA, 19 nt, Artificial Sequence
  Synthetic Target Sequence/siNA sense region
guugggucgcgaaaggccu

SEQ ID NO: 166 - RNA, 19 nt, Artificial Sequence
  Synthetic Target Sequence/siNA sense region
aguaguguugggucgcgaa

SEQ ID NO: 167 - RNA, 19 nt, Artificial Sequence
  Synthetic Target Sequence/siNA sense region
uugggucgcgaaaggccuu

SEQ ID NO: 168 - RNA, 19 nt, Artificial Sequence
  Synthetic Target Sequence/siNA sense region
uccccugugaggaacuacu

SEQ ID NO: 169 - RNA, 19 nt, Artificial Sequence
  Synthetic Target Sequence/siNA sense region
uacugucuucacgcagaaa

SEQ ID NO: 170 - RNA, 19 nt, Artificial Sequence
  Synthetic Target Sequence/siNA sense region
guguugggucgcgaaaggc

SEQ ID NO: 171 - RNA, 19 nt, Artificial Sequence
  Synthetic Target Sequence/siNA sense region
acuacugucuucacgcaga

SEQ ID NO: 172 - RNA, 19 nt, Artificial Sequence
  Synthetic Target Sequence/siNA sense region
cugucuucacgcagaaagc

SEQ ID NO: 173 - RNA, 19 nt, Artificial Sequence
  Synthetic Target Sequence/siNA sense region
gggucgcgaaaggccuugu

SEQ ID NO: 174 - RNA, 19 nt, Artificial Sequence
  Synthetic Target Sequence/siNA sense region
ccuaaaccucaaagaaaaa

SEQ ID NO: 175 - RNA, 19 nt, Artificial Sequence
  Synthetic Target Sequence/siNA sense region
ggucgcgaaaggccuugug

SEQ ID NO: 176 - RNA, 19 nt, Artificial Sequence
  Synthetic Target Sequence/siNA sense region
cuaaaccucaaagaaaaac

SEQ ID NO: 177 - RNA, 19 nt, Artificial Sequence
  Synthetic Target Sequence/siNA sense region
uguugggucgcgaaaggcc

SEQ ID NO: 178 - RNA, 19 nt, Artificial Sequence
  Synthetic Target Sequence/siNA sense region
cuccccugugaggaacuac

SEQ ID NO: 179 - RNA, 19 nt, Artificial Sequence
  Synthetic Target Sequence/siNA sense region
uccuaaaccucaaagaaaa

SEQ ID NO: 180 - RNA, 19 nt, Artificial Sequence
  Synthetic Target Sequence/siNA sense region
accggguccuuucuuggau

SEQ ID NO: 181 - RNA, 19 nt, Artificial Sequence
  Synthetic Target Sequence/siNA sense region
aauccuaaaccucaaagaa

SEQ ID NO: 182 - RNA, 19 nt, Artificial Sequence
  Synthetic Target Sequence/siNA sense region
ucaaugccuggagauuugg

SEQ ID NO: 183 - RNA, 19 nt, Artificial Sequence
  Synthetic Target Sequence/siNA sense region
augccuggagauuugggcg

SEQ ID NO: 184 - RNA, 19 nt, Artificial Sequence
  Synthetic Target Sequence/siNA sense region
aaugccuggagauuugggc

SEQ ID NO: 185 - RNA, 19 nt, Artificial Sequence
  Synthetic Target Sequence/siNA sense region
ccgaccucaugggguacau

SEQ ID NO: 186 - RNA, 19 nt, Artificial Sequence
  Synthetic Target Sequence/siNA sense region
gcucaaugccuggagauuu

SEQ ID NO: 187 - RNA, 19 nt, Artificial Sequence
  Synthetic Target Sequence/siNA sense region
cucaaugccuggagauuug

SEQ ID NO: 188 - RNA, 19 nt, Artificial Sequence
  Synthetic Target Sequence/siNA sense region
gcuagccgaguaguguugg

SEQ ID NO: 189 - RNA, 19 nt, Artificial Sequence
  Synthetic Target Sequence/siNA sense region
cgcucaaugccuggagauu

SEQ ID NO: 190 - RNA, 19 nt, Artificial Sequence
  Synthetic Target Sequence/siNA sense region
caaugccuggagauuuggg

SEQ ID NO: 191 - RNA, 19 nt, Artificial Sequence
  Synthetic Target Sequence/siNA sense region
gccgaccucaugggguaca

SEQ ID NO: 192 - RNA, 19 nt, Artificial Sequence
  Synthetic Target Sequence/siNA sense region
auccuaaaccucaaagaaa

SEQ ID NO: 193 - RNA, 19 nt, Artificial Sequence
  Synthetic Target Sequence/siNA sense region
agauuugggcgugcccccg

SEQ ID NO: 194 - RNA, 19 nt, Artificial Sequence
  Synthetic Target Sequence/siNA sense region
cccgcucaaugccuggaga

SEQ ID NO: 195 - RNA, 19 nt, Artificial Sequence
  Synthetic Target Sequence/siNA sense region
gagauuugggcgugccccc

SEQ ID NO: 196 - RNA, 19 nt, Artificial Sequence
  Synthetic Target Sequence/siNA sense region
ggagauuugggcgugcccc

SEQ ID NO: 197 - RNA, 19 nt, Artificial Sequence
  Synthetic Target Sequence/siNA sense region
gauuugggcgugcccccgc

SEQ ID NO: 198 - RNA, 19 nt, Artificial Sequence
  Synthetic Target Sequence/siNA sense region
ccgcucaaugccuggagau

SEQ ID NO: 199 - RNA, 19 nt, Artificial Sequence
  Synthetic Target Sequence/siNA sense region
aguacaccggaauugccag

SEQ ID NO: 200 - RNA, 19 nt, Artificial Sequence
  Synthetic Target Sequence/siNA sense region
uacaccggaauugccagga

SEQ ID NO: 201 - RNA, 19 nt, Artificial Sequence
  Synthetic Target Sequence/siNA sense region
gaguacaccggaauugcca

SEQ ID NO: 202 - RNA, 19 nt, Artificial Sequence
  Synthetic Target Sequence/siNA sense region
guacaccggaauugccagg

SEQ ID NO: 203 - RNA, 19 nt, Artificial Sequence
  Synthetic Target Sequence/siNA sense region
uugccgcgcaggggcccca

SEQ ID NO: 204 - RNA, 19 nt, Artificial Sequence
  Synthetic Target Sequence/siNA sense region
cuggagauuugggcgugcc

SEQ ID NO: 205 - RNA, 19 nt, Artificial Sequence
  Synthetic Target Sequence/siNA sense region
guugccgcgcaggggcccc

SEQ ID NO: 206 - RNA, 19 nt, Artificial Sequence
  Synthetic Target Sequence/siNA sense region
gccuggagauuugggcgug

SEQ ID NO: 207 - RNA, 19 nt, Artificial Sequence
  Synthetic Target Sequence/siNA sense region
uggagauuugggcgugccc

SEQ ID NO: 208 - RNA, 19 nt, Artificial Sequence
  Synthetic Target Sequence/siNA sense region
ccuggagauuugggcgugc

SEQ ID NO: 209 - RNA, 19 nt, Artificial Sequence
  Synthetic Target Sequence/siNA sense region
ugcuagccgaguaguguug

SEQ ID NO: 210 - RNA, 19 nt, Artificial Sequence
  Synthetic Target Sequence/siNA sense region
ugccuggagauuugggcgu

SEQ ID NO: 211 - RNA, 19 nt, Artificial Sequence
  Synthetic Target Sequence/siNA sense region
cugcuagccgaguaguguu

SEQ ID NO: 212 - RNA, 19 nt, Artificial Sequence
  Synthetic Target Sequence/siNA sense region
acugcuagccgaguagugu

SEQ ID NO: 213 - RNA, 19 nt, Artificial Sequence
  Synthetic Target Sequence/siNA sense region
gacugcuagccgaguagug

SEQ ID NO: 214 - RNA, 19 nt, Artificial Sequence
  Synthetic Target Sequence/siNA sense region
agacugcuagccgaguagu

SEQ ID NO: 215 - RNA, 19 nt, Artificial Sequence
  Synthetic Target Sequence/siNA sense region
acccgcucaaugccuggag

SEQ ID NO: 216 - RNA, 19 nt, Artificial Sequence
  Synthetic Target Sequence/siNA sense region
aacccgcucaaugccugga

SEQ ID NO: 217 - RNA, 19 nt, Artificial Sequence
  Synthetic Target Sequence/siNA sense region
ugccgcgcaggggccccag

SEQ ID NO: 218 - RNA, 19 nt, Artificial Sequence
  Synthetic Target Sequence/siNA sense region
aggggccccagguugggug

SEQ ID NO: 219 - RNA, 19 nt, Artificial Sequence
  Synthetic Target Sequence/siNA sense region
gggccccagguugggugug

SEQ ID NO: 220 - RNA, 19 nt, Artificial Sequence
  Synthetic Target Sequence/siNA sense region
caggggccccagguugggu

SEQ ID NO: 221 - RNA, 19 nt, Artificial Sequence
  Synthetic Target Sequence/siNA sense region
ggccccagguugggugugc

SEQ ID NO: 222 - RNA, 19 nt, Artificial Sequence
  Synthetic Target Sequence/siNA sense region
cgcaggggccccagguugg

SEQ ID NO: 223 - RNA, 19 nt, Artificial Sequence
  Synthetic Target Sequence/siNA sense region
ugggcaggauggcuccugu

SEQ ID NO: 224 - RNA, 19 nt, Artificial Sequence
  Synthetic Target Sequence/siNA sense region
gccccagguugggugugcg

SEQ ID NO: 225 - RNA, 19 nt, Artificial Sequence
  Synthetic Target Sequence/siNA sense region
gcaggggccccagguuggg

SEQ ID NO: 226 - RNA, 19 nt, Artificial Sequence
  Synthetic Target Sequence/siNA sense region
gggcaggauggcuccuguc

SEQ ID NO: 227 - RNA, 19 nt, Artificial Sequence
  Synthetic Target Sequence/siNA sense region
ggggccccagguugggugu

SEQ ID NO: 228 - RNA, 19 nt, Artificial Sequence
  Synthetic Target Sequence/siNA sense region
gccgcgcaggggccccagg

SEQ ID NO: 229 - RNA, 19 nt, Artificial Sequence
  Synthetic Target Sequence/siNA sense region
gcgcaggggccccagguug

SEQ ID NO: 230 - RNA, 19 nt, Artificial Sequence
  Synthetic Target Sequence/siNA sense region
cgcgcaggggccccagguu

SEQ ID NO: 231 - RNA, 19 nt, Artificial Sequence
  Synthetic Target Sequence/siNA sense region
ccgcgcaggggccccaggu

SEQ ID NO: 232 - RNA, 19 nt, Artificial Sequence
  Synthetic Target Sequence/siNA sense region
aggacgaccggguccuuuc

SEQ ID NO: 233 - RNA, 19 nt, Artificial Sequence
  Synthetic Target Sequence/siNA sense region
caggacgaccggguccuuu

SEQ ID NO: 234 - RNA, 19 nt, Artificial Sequence
  Synthetic Target Sequence/siNA sense region
ugccaggacgaccgggucc

SEQ ID NO: 235 - RNA, 19 nt, Artificial Sequence
  Synthetic Target Sequence/siNA sense region
auugccaggacgaccgggu

SEQ ID NO: 236 - RNA, 19 nt, Artificial Sequence
  Synthetic Target Sequence/siNA sense region
aauugccaggacgaccggg

SEQ ID NO: 237 - RNA, 19 nt, Artificial Sequence
  Synthetic Target Sequence/siNA sense region
uugccaggacgaccggguc

SEQ ID NO: 238 - RNA, 19 nt, Artificial Sequence
  Synthetic Target Sequence/siNA sense region
ccaggacgaccggguccuu

SEQ ID NO: 239 - RNA, 19 nt, Artificial Sequence
  Synthetic Target Sequence/siNA sense region
gccaggacgaccggguccu

SEQ ID NO: 240 - RNA, 19 nt, Artificial Sequence
  Synthetic Target Sequence/siNA sense region
gaauugccaggacgaccgg

SEQ ID NO: 241 - RNA, 19 nt, Artificial Sequence
  Synthetic Target Sequence/siNA sense region
acgaccggguccuuucuug

SEQ ID NO: 242 - RNA, 19 nt, Artificial Sequence
  Synthetic Target Sequence/siNA sense region
gacgaccggguccuuucuu

SEQ ID NO: 243 - RNA, 19 nt, Artificial Sequence
  Synthetic Target Sequence/siNA sense region
cgaccggguccuuucuugg

SEQ ID NO: 244 - RNA, 19 nt, Artificial Sequence
  Synthetic Target Sequence/siNA sense region
ggacgaccggguccuuucu

SEQ ID NO: 245 - RNA, 19 nt, Artificial Sequence
  Synthetic Target Sequence/siNA sense region
ccggaauugccaggacgac

SEQ ID NO: 246 - RNA, 19 nt, Artificial Sequence
  Synthetic Target Sequence/siNA sense region
acaccggaauugccaggac

SEQ ID NO: 247 - RNA, 19 nt, Artificial Sequence
  Synthetic Target Sequence/siNA sense region
accggaauugccaggacga

SEQ ID NO: 248 - RNA, 19 nt, Artificial Sequence
  Synthetic Target Sequence/siNA sense region
cggaauugccaggacgacc

SEQ ID NO: 249 - RNA, 19 nt, Artificial Sequence
  Synthetic Target Sequence/siNA sense region
ggaauugccaggacgaccg

SEQ ID NO: 250 - RNA, 19 nt, Artificial Sequence
  Synthetic Target Sequence/siNA sense region
caccggaauugccaggacg

SEQ ID NO: 251 - RNA, 19 nt, Artificial Sequence
  Synthetic Target Sequence/siNA sense region
ccccagguugggugugcgc

SEQ ID NO: 252 - RNA, 19 nt, Artificial Sequence
  Synthetic Target Sequence/siNA sense region
gaucguugguggaguuuac

SEQ ID NO: 253 - RNA, 19 nt, Artificial Sequence
  Synthetic Target Sequence/siNA sense region
cagaucguugguggaguuu

SEQ ID NO: 254 - RNA, 19 nt, Artificial Sequence
  Synthetic Target Sequence/siNA sense region
agaucguugguggaguuua

SEQ ID NO: 255 - RNA, 19 nt, Artificial Sequence
  Synthetic Target Sequence/siNA sense region
cccagguugggugugcgcg

SEQ ID NO: 256 - RNA, 19 nt, Artificial Sequence
  Synthetic Target Sequence/siNA sense region
ccagguugggugugcgcgc

SEQ ID NO: 257 - RNA, 19 nt, Artificial Sequence
  Synthetic Target Sequence/siNA sense region
agguugggugugcgcgcga

SEQ ID NO: 258 - RNA, 19 nt, Artificial Sequence
  Synthetic Target Sequence/siNA sense region
cagguugggugugcgcgcg

SEQ ID NO: 259 - RNA, 19 nt, Artificial Sequence
  Synthetic Target Sequence/siNA sense region
gguugggugugcgcgcgac

SEQ ID NO: 260 - RNA, 19 nt, Artificial Sequence
  Synthetic Target Sequence/siNA sense region
gaaaaaccaaacguaacac

SEQ ID NO: 261 - RNA, 19 nt, Artificial Sequence
  Synthetic Target Sequence/siNA sense region
agaaaaaccaaacguaaca

SEQ ID NO: 262 - RNA, 19 nt, Artificial Sequence
  Synthetic Target Sequence/siNA sense region
aaccaaacguaacaccaac

SEQ ID NO: 263 - RNA, 19 nt, Artificial Sequence
  Synthetic Target Sequence/siNA sense region
aaagaaaaaccaaacguaa

SEQ ID NO: 264 - RNA, 19 nt, Artificial Sequence
  Synthetic Target Sequence/siNA sense region
aaaaaccaaacguaacacc

SEQ ID NO: 265 - RNA, 19 nt, Artificial Sequence
  Synthetic Target Sequence/siNA sense region
aagaaaaaccaaacguaac

SEQ ID NO: 266 - RNA, 19 nt, Artificial Sequence
  Synthetic Target Sequence/siNA sense region
caaagaaaaaccaaacgua

SEQ ID NO: 267 - RNA, 19 nt, Artificial Sequence
  Synthetic Target Sequence/siNA sense region
acccccggcguaggucgcg

SEQ ID NO: 268 - RNA, 19 nt, Artificial Sequence
  Synthetic Target Sequence/siNA sense region
gacccccggcguaggucgc

SEQ ID NO: 269 - RNA, 19 nt, Artificial Sequence
  Synthetic Target Sequence/siNA sense region
cguuaguaugagugucgug

SEQ ID NO: 270 - RNA, 19 nt, Artificial Sequence
  Synthetic Target Sequence/siNA sense region
guuaguaugagugucgugc

SEQ ID NO: 271 - RNA, 19 nt, Artificial Sequence
  Synthetic Target Sequence/siNA sense region
uuaguaugagugucgugca

SEQ ID NO: 272 - RNA, 19 nt, Artificial Sequence
  Synthetic Target Sequence/siNA sense region
ccaaacguaacaccaaccg

SEQ ID NO: 273 - RNA, 19 nt, Artificial Sequence
  Synthetic Target Sequence/siNA sense region
accaaacguaacaccaacc

SEQ ID NO: 274 - RNA, 19 nt, Artificial Sequence
  Synthetic Target Sequence/siNA sense region
uugggcgugcccccgcgag

SEQ ID NO: 275 - RNA, 19 nt, Artificial Sequence
  Synthetic Target Sequence/siNA sense region
auuugggcgugcccccgcg

SEQ ID NO: 276 - RNA, 19 nt, Artificial Sequence
  Synthetic Target Sequence/siNA sense region
uuugggcgugcccccgcga

SEQ ID NO: 277 - RNA, 19 nt, Artificial Sequence
  Synthetic Target Sequence/siNA sense region
aaaccaaacguaacaccaa

SEQ ID NO: 278 - RNA, 19 nt, Artificial Sequence
  Synthetic Target Sequence/siNA sense region
ugggcgugcccccgcgaga

SEQ ID NO: 279 - RNA, 19 nt, Artificial Sequence
  Synthetic Target Sequence/siNA sense region
gucagaucguugguggagu

SEQ ID NO: 280 - RNA, 19 nt, Artificial Sequence
  Synthetic Target Sequence/siNA sense region
gugucgugcagccuccagg

SEQ ID NO: 281 - RNA, 19 nt, Artificial Sequence
  Synthetic Target Sequence/siNA sense region
ggucagaucguugguggag

SEQ ID NO: 282 - RNA, 19 nt, Artificial Sequence
  Synthetic Target Sequence/siNA sense region
agugucgugcagccuccag

SEQ ID NO: 283 - RNA, 19 nt, Artificial Sequence
  Synthetic Target Sequence/siNA sense region
gagugucgugcagccucca

SEQ ID NO: 284 - RNA, 19 nt, Artificial Sequence
  Synthetic Target Sequence/siNA sense region
ucguagaccgugcaccaug

SEQ ID NO: 285 - RNA, 19 nt, Artificial Sequence
  Synthetic Target Sequence/siNA sense region
gaccgugcaccaugagcac

SEQ ID NO: 286 - RNA, 19 nt, Artificial Sequence
  Synthetic Target Sequence/siNA sense region
aguaugagugucgugcagc

SEQ ID NO: 287 - RNA, 19 nt, Artificial Sequence
  Synthetic Target Sequence/siNA sense region
uaguaugagugucgugcag

SEQ ID NO: 288 - RNA, 19 nt, Artificial Sequence
  Synthetic Target Sequence/siNA sense region
ucagaucguugguggaguu

SEQ ID NO: 289 - RNA, 19 nt, Artificial Sequence
  Synthetic Target Sequence/siNA sense region
agaccgugcaccaugagca

SEQ ID NO: 290 - RNA, 19 nt, Artificial Sequence
  Synthetic Target Sequence/siNA sense region
aaaaccaaacguaacacca

SEQ ID NO: 291 - RNA, 19 nt, Artificial Sequence
  Synthetic Target Sequence/siNA sense region
guagaccgugcaccaugag

SEQ ID NO: 292 - RNA, 19 nt, Artificial Sequence
  Synthetic Target Sequence/siNA sense region
cucguagaccgugcaccau

SEQ ID NO: 293 - RNA, 19 nt, Artificial Sequence
  Synthetic Target Sequence/siNA sense region
cguagaccgugcaccauga

SEQ ID NO: 294 - RNA, 19 nt, Artificial Sequence
  Synthetic Target Sequence/siNA sense region
ccugggcucagcccgggua

SEQ ID NO: 295 - RNA, 19 nt, Artificial Sequence
  Synthetic Target Sequence/siNA sense region
uagaccgugcaccaugagc

SEQ ID NO: 296 - RNA, 19 nt, Artificial Sequence
  Synthetic Target Sequence/siNA sense region
ggucucguagaccgugcac

SEQ ID NO: 297 - RNA, 19 nt, Artificial Sequence
  Synthetic Target Sequence/siNA sense region
ucucguagaccgugcacca

SEQ ID NO: 298 - RNA, 19 nt, Artificial Sequence
  Synthetic Target Sequence/siNA sense region
gucucguagaccgugcacc

SEQ ID NO: 299 - RNA, 19 nt, Artificial Sequence
  Synthetic Target Sequence/siNA sense region
uuggguaaggucaucgaua

SEQ ID NO: 300 - RNA, 19 nt, Artificial Sequence
  Synthetic Target Sequence/siNA sense region
ucgccgaccucauggggua

SEQ ID NO: 301 - RNA, 19 nt, Artificial Sequence
  Synthetic Target Sequence/siNA sense region
ccucaaagaaaaaccaaac

SEQ ID NO: 302 - RNA, 19 nt, Artificial Sequence
  Synthetic Target Sequence/siNA sense region
gggcgugcccccgcgagac

SEQ ID NO: 303 - RNA, 19 nt, Artificial Sequence
  Synthetic Target Sequence/siNA sense region
ggaugaaccggcugauagc

SEQ ID NO: 304 - RNA, 19 nt, Artificial Sequence
  Synthetic Target Sequence/siNA sense region
uggaugaaccggcugauag

SEQ ID NO: 305 - RNA, 19 nt, Artificial Sequence
  Synthetic Target Sequence/siNA sense region
cucaaagaaaaaccaaacg

SEQ ID NO: 306 - RNA, 19 nt, Artificial Sequence
  Synthetic Target Sequence/siNA sense region
aggaagacuuccgagcggu

SEQ ID NO: 307 - RNA, 19 nt, Artificial Sequence
  Synthetic Target Sequence/siNA sense region
ucaaagaaaaaccaaacgu

SEQ ID NO: 308 - RNA, 19 nt, Artificial Sequence
  Synthetic Target Sequence/siNA sense region
ggaagacuuccgagcgguc

SEQ ID NO: 309 - RNA, 19 nt, Artificial Sequence
  Synthetic Target Sequence/siNA sense region
cgccgaccucaugggguac

SEQ ID NO: 310 - RNA, 19 nt, Artificial Sequence
  Synthetic Target Sequence/siNA sense region
cuuccgagcggucgcaacc

SEQ ID NO: 311 - RNA, 19 nt, Artificial Sequence
  Synthetic Target Sequence/siNA sense region
ggcgugcccccgcgagacu

SEQ ID NO: 312 - RNA, 19 nt, Artificial Sequence
  Synthetic Target Sequence/siNA sense region
uaugagugucgugcagccu

SEQ ID NO: 313 - RNA, 19 nt, Artificial Sequence
  Synthetic Target Sequence/siNA sense region
ugcccccgcgagacugcua

SEQ ID NO: 314 - RNA, 19 nt, Artificial Sequence
  Synthetic Target Sequence/siNA sense region
cgagacugcuagccgagua

SEQ ID NO: 315 - RNA, 19 nt, Artificial Sequence
  Synthetic Target Sequence/siNA sense region
ugagugucgugcagccucc

SEQ ID NO: 316 - RNA, 19 nt, Artificial Sequence
  Synthetic Target Sequence/siNA sense region
gcccccgcgagacugcuag

SEQ ID NO: 317 - RNA, 19 nt, Artificial Sequence
  Synthetic Target Sequence/siNA sense region
gagacugcuagccgaguag

SEQ ID NO: 318 - RNA, 19 nt, Artificial Sequence
  Synthetic Target Sequence/siNA sense region
cccccgcgagacugcuagc

SEQ ID NO: 319 - RNA, 19 nt, Artificial Sequence
  Synthetic Target Sequence/siNA sense region
cgcgagacugcuagccgag

SEQ ID NO: 320 - RNA, 19 nt, Artificial Sequence
  Synthetic Target Sequence/siNA sense region
guaugagugucgugcagcc

SEQ ID NO: 321 - RNA, 19 nt, Artificial Sequence
  Synthetic Target Sequence/siNA sense region
augagugucgugcagccuc

SEQ ID NO: 322 - RNA, 19 nt, Artificial Sequence
  Synthetic Target Sequence/siNA sense region
gcgagacugcuagccgagu

SEQ ID NO: 323 - RNA, 19 nt, Artificial Sequence
  Synthetic Target Sequence/siNA sense region
ccccgcgagacugcuagcc

SEQ ID NO: 324 - RNA, 19 nt, Artificial Sequence
  Synthetic Target Sequence/siNA sense region
ccgcgagacugcuagccga

SEQ ID NO: 325 - RNA, 19 nt, Artificial Sequence
  Synthetic Target Sequence/siNA sense region
cccgcgagacugcuagccg

SEQ ID NO: 326 - RNA, 19 nt, Artificial Sequence
  Synthetic Target Sequence/siNA sense region
gcgugcccccgcgagacug

SEQ ID NO: 327 - RNA, 19 nt, Artificial Sequence
  Synthetic Target Sequence/siNA sense region
gacccccccucccgggaga

SEQ ID NO: 328 - RNA, 19 nt, Artificial Sequence
  Synthetic Target Sequence/siNA sense region
cggguccuuucuuggauca

SEQ ID NO: 329 - RNA, 19 nt, Artificial Sequence
  Synthetic Target Sequence/siNA sense region
gugcccccgcgagacugcu

SEQ ID NO: 330 - RNA, 19 nt, Artificial Sequence
  Synthetic Target Sequence/siNA sense region
cgugcccccgcgagacugc

SEQ ID NO: 331 - RNA, 19 nt, Artificial Sequence
  Synthetic Target Sequence/siNA sense region
uucgccgaccucauggggu

SEQ ID NO: 332 - RNA, 19 nt, Artificial Sequence
  Synthetic Target Sequence/siNA sense region
cgcccacaggacgucaagu

SEQ ID NO: 333 - RNA, 19 nt, Artificial Sequence
  Synthetic Target Sequence/siNA sense region
gcccacaggacgucaaguu

SEQ ID NO: 334 - RNA, 19 nt, Artificial Sequence
  Synthetic Target Sequence/siNA sense region
acccccccucccgggagag

SEQ ID NO: 335 - RNA, 19 nt, Artificial Sequence
  Synthetic Target Sequence/siNA sense region
ggacccccccucccgggag

SEQ ID NO: 336 - RNA, 19 nt, Artificial Sequence
  Synthetic Target Sequence/siNA sense region
ccggguccuuucuuggauc

SEQ ID NO: 337 - RNA, 19 nt, Artificial Sequence
  Synthetic Target Sequence/siNA sense region
caggacccccccucccggg

SEQ ID NO: 338 - RNA, 19 nt, Artificial Sequence
  Synthetic Target Sequence/siNA sense region
aggacgucaaguucccggg

SEQ ID NO: 339 - RNA, 19 nt, Artificial Sequence
  Synthetic Target Sequence/siNA sense region
aggacccccccucccggga

SEQ ID NO: 340 - RNA, 19 nt, Artificial Sequence
  Synthetic Target Sequence/siNA sense region
ccacaggacgucaaguucc

SEQ ID NO: 341 - RNA, 19 nt, Artificial Sequence
  Synthetic Target Sequence/siNA sense region
caggacgucaaguucccgg

SEQ ID NO: 342 - RNA, 19 nt, Artificial Sequence
  Synthetic Target Sequence/siNA sense region
acaggacgucaaguucccg

SEQ ID NO: 343 - RNA, 19 nt, Artificial Sequence
  Synthetic Target Sequence/siNA sense region
cacaggacgucaaguuccc

SEQ ID NO: 344 - RNA, 19 nt, Artificial Sequence
  Synthetic Target Sequence/siNA sense region
caguggaugaaccggcuga

SEQ ID NO: 345 - RNA, 19 nt, Artificial Sequence
  Synthetic Target Sequence/siNA sense region
gggcucagcccggguaccc

SEQ ID NO: 346 - RNA, 19 nt, Artificial Sequence
  Synthetic Target Sequence/siNA sense region
ccgagcggucgcaaccucg

SEQ ID NO: 347 - RNA, 19 nt, Artificial Sequence
  Synthetic Target Sequence/siNA sense region
cugggcucagcccggguac

SEQ ID NO: 348 - RNA, 19 nt, Artificial Sequence
  Synthetic Target Sequence/siNA sense region
aguggaugaaccggcugau

SEQ ID NO: 349 - RNA, 19 nt, Artificial Sequence
  Synthetic Target Sequence/siNA sense region
uccgagcggucgcaaccuc

SEQ ID NO: 350 - RNA, 19 nt, Artificial Sequence
  Synthetic Target Sequence/siNA sense region
ugggcucagcccggguacc

SEQ ID NO: 351 - RNA, 19 nt, Artificial Sequence
  Synthetic Target Sequence/siNA sense region
gguacccuuggccccucua

SEQ ID NO: 352 - RNA, 19 nt, Artificial Sequence
  Synthetic Target Sequence/siNA sense region
uuccgagcggucgcaaccu

SEQ ID NO: 353 - RNA, 19 nt, Artificial Sequence
  Synthetic Target Sequence/siNA sense region
ggguacccuuggccccucu

SEQ ID NO: 354 - RNA, 19 nt, Artificial Sequence
  Synthetic Target Sequence/siNA sense region
ggguccuuucuuggaucaa

SEQ ID NO: 355 - RNA, 19 nt, Artificial Sequence
  Synthetic Target Sequence/siNA sense region
cccacaggacgucaaguuc

SEQ ID NO: 356 - RNA, 19 nt, Artificial Sequence
  Synthetic Target Sequence/siNA sense region
gguugcucuuucucuaucu

SEQ ID NO: 357 - RNA, 19 nt, Artificial Sequence
  Synthetic Target Sequence/siNA sense region
gugggcaggauggcuccug

SEQ ID NO: 358 - RNA, 19 nt, Artificial Sequence
  Synthetic Target Sequence/siNA sense region
ggugggcaggauggcuccu

SEQ ID NO: 359 - RNA, 19 nt, Artificial Sequence
  Synthetic Target Sequence/siNA sense region
guugcucuuucucuaucuu

SEQ ID NO: 360 - RNA, 19 nt, Artificial Sequence
  Synthetic Target Sequence/siNA sense region
guggaugaaccggcugaua

SEQ ID NO: 361 - RNA, 19 nt, Artificial Sequence
  Synthetic Target Sequence/siNA sense region
ccaggacccccccucccgg

SEQ ID NO: 362 - RNA, 19 nt, Artificial Sequence
  Synthetic Target Sequence/siNA sense region
gggugggcaggauggcucc

SEQ ID NO: 363 - RNA, 19 nt, Artificial Sequence
  Synthetic Target Sequence/siNA sense region
cuucacggaggcuaugacu

SEQ ID NO: 364 - RNA, 19 nt, Artificial Sequence
  Synthetic Target Sequence/siNA sense region
accgccgcccacaggacgu

SEQ ID NO: 365 - RNA, 19 nt, Artificial Sequence
  Synthetic Target Sequence/siNA sense region
uccaggacccccccucccg

SEQ ID NO: 366 - RNA, 19 nt, Artificial Sequence
  Synthetic Target Sequence/siNA sense region
auaugaugaugaacugguc

SEQ ID NO: 367 - RNA, 19 nt, Artificial Sequence
  Synthetic Target Sequence/siNA sense region
uucacggaggcuaugacua

SEQ ID NO: 368 - RNA, 19 nt, Artificial Sequence
  Synthetic Target Sequence/siNA sense region
ucacggaggcuaugacuag

SEQ ID NO: 369 - RNA, 19 nt, Artificial Sequence
  Synthetic Target Sequence/siNA sense region
augaaccggcugauagcgu

SEQ ID NO: 370 - RNA, 19 nt, Artificial Sequence
  Synthetic Target Sequence/siNA sense region
gggauaugaugaugaacug

SEQ ID NO: 371 - RNA, 19 nt, Artificial Sequence
  Synthetic Target Sequence/siNA sense region
ugcaguggaugaaccggcu

SEQ ID NO: 372 - RNA, 19 nt, Artificial Sequence
  Synthetic Target Sequence/siNA sense region
gugcaguggaugaaccggc

SEQ ID NO: 373 - RNA, 19 nt, Artificial Sequence
  Synthetic Target Sequence/siNA sense region
ugaaccggcugauagcguu

SEQ ID NO: 374 - RNA, 19 nt, Artificial Sequence
  Synthetic Target Sequence/siNA sense region
ggauaugaugaugaacugg

SEQ ID NO: 375 - RNA, 19 nt, Artificial Sequence
  Synthetic Target Sequence/siNA sense region
gcucuuucucuaucuuccu

SEQ ID NO: 376 - RNA, 19 nt, Artificial Sequence
  Synthetic Target Sequence/siNA sense region
gggggcgacacuccaccau

SEQ ID NO: 377 - RNA, 19 nt, Artificial Sequence
  Synthetic Target Sequence/siNA sense region
gaugaaccggcugauagcg

SEQ ID NO: 378 - RNA, 19 nt, Artificial Sequence
  Synthetic Target Sequence/siNA sense region
gauaugaugaugaacuggu

SEQ ID NO: 379 - RNA, 19 nt, Artificial Sequence
  Synthetic Target Sequence/siNA sense region
ugggauaugaugaugaacu

SEQ ID NO: 380 - RNA, 19 nt, Artificial Sequence
  Synthetic Target Sequence/siNA sense region
uugcucuuucucuaucuuc

SEQ ID NO: 381 - RNA, 19 nt, Artificial Sequence
  Synthetic Target Sequence/siNA sense region
ugggggcgacacuccacca

SEQ ID NO: 382 - RNA, 19 nt, Artificial Sequence
  Synthetic Target Sequence/siNA sense region
ugcucuuucucuaucuucc

SEQ ID NO: 383 - RNA, 19 nt, Artificial Sequence
  Synthetic Target Sequence/siNA sense region
gguccuuucuuggaucaac

SEQ ID NO: 384 - RNA, 19 nt, Artificial Sequence
  Synthetic Target Sequence/siNA sense region
aagacuuccgagcggucgc

SEQ ID NO: 385 - RNA, 19 nt, Artificial Sequence
  Synthetic Target Sequence/siNA sense region
agcccggguacccuuggcc

SEQ ID NO: 386 - RNA, 19 nt, Artificial Sequence
  Synthetic Target Sequence/siNA sense region
uuucuuggaucaacccgcu

SEQ ID NO: 387 - RNA, 19 nt, Artificial Sequence
  Synthetic Target Sequence/siNA sense region
cagcccggguacccuuggc

SEQ ID NO: 388 - RNA, 19 nt, Artificial Sequence
  Synthetic Target Sequence/siNA sense region
agacuuccgagcggucgca

SEQ ID NO: 389 - RNA, 19 nt, Artificial Sequence
  Synthetic Target Sequence/siNA sense region
uucuuggaucaacccgcuc

SEQ ID NO: 390 - RNA, 19 nt, Artificial Sequence
  Synthetic Target Sequence/siNA sense region
cccggguacccuuggcccc

SEQ ID NO: 391 - RNA, 19 nt, Artificial Sequence
  Synthetic Target Sequence/siNA sense region
guccuuucuuggaucaacc

SEQ ID NO: 392 - RNA, 19 nt, Artificial Sequence
  Synthetic Target Sequence/siNA sense region
cuuucuuggaucaacccgc

SEQ ID NO: 393 - RNA, 19 nt, Artificial Sequence
  Synthetic Target Sequence/siNA sense region
ccuuucuuggaucaacccg

SEQ ID NO: 394 - RNA, 19 nt, Artificial Sequence
  Synthetic Target Sequence/siNA sense region
uccuuucuuggaucaaccc

SEQ ID NO: 395 - RNA, 19 nt, Artificial Sequence
  Synthetic Target Sequence/siNA sense region
aaguucccgggcggugguc

SEQ ID NO: 396 - RNA, 19 nt, Artificial Sequence
  Synthetic Target Sequence/siNA sense region
gcaguggaugaaccggcug

SEQ ID NO: 397 - RNA, 19 nt, Artificial Sequence
  Synthetic Target Sequence/siNA sense region
ccggguacccuuggccccu

SEQ ID NO: 398 - RNA, 19 nt, Artificial Sequence
  Synthetic Target Sequence/siNA sense region
aguucccgggcggugguca

SEQ ID NO: 399 - RNA, 19 nt, Artificial Sequence
  Synthetic Target Sequence/siNA sense region
cuuggaucaacccgcucaa

SEQ ID NO: 400 - RNA, 19 nt, Artificial Sequence
  Synthetic Target Sequence/siNA sense region
ggaucaacccgcucaaugc

SEQ ID NO: 401 - RNA, 19 nt, Artificial Sequence
  Synthetic Target Sequence/siNA sense region
acuuccgagcggucgcaac

SEQ ID NO: 402 - RNA, 19 nt, Artificial Sequence
  Synthetic Target Sequence/siNA sense region
ucuuggaucaacccgcuca

SEQ ID NO: 403 - RNA, 19 nt, Artificial Sequence
  Synthetic Target Sequence/siNA sense region
uuggaucaacccgcucaau

SEQ ID NO: 404 - RNA, 19 nt, Artificial Sequence
  Synthetic Target Sequence/siNA sense region
aaccgccgcccacaggacg

SEQ ID NO: 405 - RNA, 19 nt, Artificial Sequence
  Synthetic Target Sequence/siNA sense region
gcgugaacuaugcaacagg

SEQ ID NO: 406 - RNA, 19 nt, Artificial Sequence
  Synthetic Target Sequence/siNA sense region
aucaacccgcucaaugccu

SEQ ID NO: 407 - RNA, 19 nt, Artificial Sequence
  Synthetic Target Sequence/siNA sense region
gaucaacccgcucaaugcc

SEQ ID NO: 408 - RNA, 19 nt, Artificial Sequence
  Synthetic Target Sequence/siNA sense region
caacccgcucaaugccugg

SEQ ID NO: 409 - RNA, 19 nt, Artificial Sequence
  Synthetic Target Sequence/siNA sense region
gcuucgccgaccucauggg

SEQ ID NO: 410 - RNA, 19 nt, Artificial Sequence
  Synthetic Target Sequence/siNA sense region
gacuuccgagcggucgcaa

SEQ ID NO: 411 - RNA, 19 nt, Artificial Sequence
  Synthetic Target Sequence/siNA sense region
ucaacccgcucaaugccug

SEQ ID NO: 412 - RNA, 19 nt, Artificial Sequence
  Synthetic Target Sequence/siNA sense region
ggcuucgccgaccucaugg

SEQ ID NO: 413 - RNA, 19 nt, Artificial Sequence
  Synthetic Target Sequence/siNA sense region
uggaucaacccgcucaaug

SEQ ID NO: 414 - RNA, 19 nt, Artificial Sequence
  Synthetic Target Sequence/siNA sense region
cgggcgguggucagaucgu

SEQ ID NO: 415 - RNA, 19 nt, Artificial Sequence
  Synthetic Target Sequence/siNA sense region
cuuggccccucuauggcaa

SEQ ID NO: 416 - RNA, 19 nt, Artificial Sequence
  Synthetic Target Sequence/siNA sense region
ccgggcgguggucagaucg

SEQ ID NO: 417 - RNA, 19 nt, Artificial Sequence
  Synthetic Target Sequence/siNA sense region
uggggugggcaggauggcu

SEQ ID NO: 418 - RNA, 19 nt, Artificial Sequence
  Synthetic Target Sequence/siNA sense region
ggaguuuaccuguugccgc

SEQ ID NO: 419 - RNA, 19 nt, Artificial Sequence
  Synthetic Target Sequence/siNA sense region
ccuuggccccucuauggca

SEQ ID NO: 420 - RNA, 19 nt, Artificial Sequence
  Synthetic Target Sequence/siNA sense region
guggaguuuaccuguugcc

SEQ ID NO: 421 - RNA, 19 nt, Artificial Sequence
  Synthetic Target Sequence/siNA sense region
gguggaguuuaccuguugc

SEQ ID NO: 422 - RNA, 19 nt, Artificial Sequence
  Synthetic Target Sequence/siNA sense region
uucccgggcgguggucaga

SEQ ID NO: 423 - RNA, 19 nt, Artificial Sequence
  Synthetic Target Sequence/siNA sense region
ugaacuaugcaacagggaa

SEQ ID NO: 424 - RNA, 19 nt, Artificial Sequence
  Synthetic Target Sequence/siNA sense region
aguuuaccuguugccgcgc

SEQ ID NO: 425 - RNA, 19 nt, Artificial Sequence
  Synthetic Target Sequence/siNA sense region
gugaacuaugcaacaggga

SEQ ID NO: 426 - RNA, 19 nt, Artificial Sequence
  Synthetic Target Sequence/siNA sense region
uuaccuguugccgcgcagg

SEQ ID NO: 427 - RNA, 19 nt, Artificial Sequence
  Synthetic Target Sequence/siNA sense region
ucccgggcgguggucagau

SEQ ID NO: 428 - RNA, 19 nt, Artificial Sequence
  Synthetic Target Sequence/siNA sense region
guucccgggcgguggucag

SEQ ID NO: 429 - RNA, 19 nt, Artificial Sequence
  Synthetic Target Sequence/siNA sense region
gcccggguacccuuggccc

SEQ ID NO: 430 - RNA, 19 nt, Artificial Sequence
  Synthetic Target Sequence/siNA sense region
aaggagaugaaggcgaagg

SEQ ID NO: 431 - RNA, 19 nt, Artificial Sequence
  Synthetic Target Sequence/siNA sense region
aggagaugaaggcgaaggc

SEQ ID NO: 432 - RNA, 19 nt, Artificial Sequence
  Synthetic Target Sequence/siNA sense region
guuuaccuguugccgcgca

SEQ ID NO: 433 - RNA, 19 nt, Artificial Sequence
  Synthetic Target Sequence/siNA sense region
cuguugccgcgcaggggcc

SEQ ID NO: 434 - RNA, 19 nt, Artificial Sequence
  Synthetic Target Sequence/siNA sense region
aacaccaaccgccgcccac

SEQ ID NO: 435 - RNA, 19 nt, Artificial Sequence
  Synthetic Target Sequence/siNA sense region
gaguuuaccuguugccgcg

SEQ ID NO: 436 - RNA, 19 nt, Artificial Sequence
  Synthetic Target Sequence/siNA sense region
uuuaccuguugccgcgcag

SEQ ID NO: 437 - RNA, 19 nt, Artificial Sequence
  Synthetic Target Sequence/siNA sense region
ggggugggcaggauggcuc

SEQ ID NO: 438 - RNA, 19 nt, Artificial Sequence
  Synthetic Target Sequence/siNA sense region
gaagacuuccgagcggucg

SEQ ID NO: 439 - RNA, 19 nt, Artificial Sequence
  Synthetic Target Sequence/siNA sense region
accuguugccgcgcagggg

SEQ ID NO: 440 - RNA, 19 nt, Artificial Sequence
  Synthetic Target Sequence/siNA sense region
uaccuguugccgcgcaggg

SEQ ID NO: 441 - RNA, 19 nt, Artificial Sequence
  Synthetic Target Sequence/siNA sense region
uaccucuucaacugggcag

SEQ ID NO: 442 - RNA, 19 nt, Artificial Sequence
  Synthetic Target Sequence/siNA sense region
cgugaacuaugcaacaggg

SEQ ID NO: 443 - RNA, 19 nt, Artificial Sequence
  Synthetic Target Sequence/siNA sense region
acaccaaccgccgcccaca

SEQ ID NO: 444 - RNA, 19 nt, Artificial Sequence
  Synthetic Target Sequence/siNA sense region
cccgggcgguggucagauc

SEQ ID NO: 445 - RNA, 19 nt, Artificial Sequence
  Synthetic Target Sequence/siNA sense region
accucuucaacugggcagu

SEQ ID NO: 446 - RNA, 19 nt, Artificial Sequence
  Synthetic Target Sequence/siNA sense region
cuucgccgaccucaugggg

SEQ ID NO: 447 - RNA, 19 nt, Artificial Sequence
  Synthetic Target Sequence/siNA sense region
ccuguugccgcgcaggggc

SEQ ID NO: 448 - RNA, 19 nt, Artificial Sequence
  Synthetic Target Sequence/siNA sense region
ccaaccgccgcccacagga

SEQ ID NO: 449 - RNA, 19 nt, Artificial Sequence
  Synthetic Target Sequence/siNA sense region
accaaccgccgcccacagg

SEQ ID NO: 450 - RNA, 19 nt, Artificial Sequence
  Synthetic Target Sequence/siNA sense region
uggaguuuaccuguugccg

SEQ ID NO: 451 - RNA, 19 nt, Artificial Sequence
  Synthetic Target Sequence/siNA sense region
caccaaccgccgcccacag

SEQ ID NO: 452 - RNA, 19 nt, Artificial Sequence
  Synthetic Target Sequence/siNA sense region
caaacguaacaccaaccgc

SEQ ID NO: 453 - RNA, 19 nt, Artificial Sequence
  Synthetic Target Sequence/siNA sense region
caagcggagacggcuggag

SEQ ID NO: 454 - RNA, 19 nt, Artificial Sequence
  Synthetic Target Sequence/siNA sense region
acggaggcuaugacuaggu

SEQ ID NO: 455 - RNA, 19 nt, Artificial Sequence
  Synthetic Target Sequence/siNA sense region
uaacaccaaccgccgccca

SEQ ID NO: 456 - RNA, 19 nt, Artificial Sequence
  Synthetic Target Sequence/siNA sense region
aucguugguggaguuuacc

SEQ ID NO: 457 - RNA, 19 nt, Artificial Sequence
  Synthetic Target Sequence/siNA sense region
gggagacauauaucacagc

SEQ ID NO: 458 - RNA, 19 nt, Artificial Sequence
  Synthetic Target Sequence/siNA sense region
aaccucguggaaggcgaca

SEQ ID NO: 459 - RNA, 19 nt, Artificial Sequence
  Synthetic Target Sequence/siNA sense region
gggggagacauauaucaca

SEQ ID NO: 460 - RNA, 19 nt, Artificial Sequence
  Synthetic Target Sequence/siNA sense region
aacguaacaccaaccgccg

SEQ ID NO: 461 - RNA, 19 nt, Artificial Sequence
  Synthetic Target Sequence/siNA sense region
aaacguaacaccaaccgcc

SEQ ID NO: 462 - RNA, 19 nt, Artificial Sequence
  Synthetic Target Sequence/siNA sense region
ggggagacauauaucacag

SEQ ID NO: 463 - RNA, 19 nt, Artificial Sequence
  Synthetic Target Sequence/siNA sense region
gagaugaaggcgaaggcgu

SEQ ID NO: 464 - RNA, 19 nt, Artificial Sequence
  Synthetic Target Sequence/siNA sense region
aagcggagacggcuggagc

SEQ ID NO: 465 - RNA, 19 nt, Artificial Sequence
  Synthetic Target Sequence/siNA sense region
guacccuuggccccucuau

SEQ ID NO: 466 - RNA, 19 nt, Artificial Sequence
  Synthetic Target Sequence/siNA sense region
ccuccaggacccccccucc

SEQ ID NO: 467 - RNA, 19 nt, Artificial Sequence
  Synthetic Target Sequence/siNA sense region
cuccaggacccccccuccc

SEQ ID NO: 468 - RNA, 19 nt, Artificial Sequence
  Synthetic Target Sequence/siNA sense region
uacccuuggccccucuaug

SEQ ID NO: 469 - RNA, 19 nt, Artificial Sequence
  Synthetic Target Sequence/siNA sense region
caaccucguggaaggcgac

SEQ ID NO: 470 - RNA, 19 nt, Artificial Sequence
  Synthetic Target Sequence/siNA sense region
cggaggcuaugacuaggua

SEQ ID NO: 471 - RNA, 19 nt, Artificial Sequence
  Synthetic Target Sequence/siNA sense region
ggagaugaaggcgaaggcg

SEQ ID NO: 472 - RNA, 19 nt, Artificial Sequence
  Synthetic Target Sequence/siNA sense region
agaugaaggcgaaggcguc

SEQ ID NO: 473 - RNA, 19 nt, Artificial Sequence
  Synthetic Target Sequence/siNA sense region
guaacaccaaccgccgccc

SEQ ID NO: 474 - RNA, 19 nt, Artificial Sequence
  Synthetic Target Sequence/siNA sense region
cguaacaccaaccgccgcc

SEQ ID NO: 475 - RNA, 19 nt, Artificial Sequence
  Synthetic Target Sequence/siNA sense region
acguaacaccaaccgccgc

SEQ ID NO: 476 - RNA, 19 nt, Artificial Sequence
  Synthetic Target Sequence/siNA sense region
cacggaggcuaugacuagg

SEQ ID NO: 477 - RNA, 19 nt, Artificial Sequence
  Synthetic Target Sequence/siNA sense region
guugguggaguuuaccugu

SEQ ID NO: 478 - RNA, 19 nt, Artificial Sequence
  Synthetic Target Sequence/siNA sense region
cguugguggaguuuaccug

SEQ ID NO: 479 - RNA, 19 nt, Artificial Sequence
  Synthetic Target Sequence/siNA sense region
acccuuggccccucuaugg

SEQ ID NO: 480 - RNA, 19 nt, Artificial Sequence
  Synthetic Target Sequence/siNA sense region
uugguggaguuuaccuguu

SEQ ID NO: 481 - RNA, 19 nt, Artificial Sequence
  Synthetic Target Sequence/siNA sense region
ugguggaguuuaccuguug

SEQ ID NO: 482 - RNA, 19 nt, Artificial Sequence
  Synthetic Target Sequence/siNA sense region
ucguugguggaguuuaccu

SEQ ID NO: 483 - RNA, 19 nt, Artificial Sequence
  Synthetic Target Sequence/siNA sense region
cggguacccuuggccccuc

SEQ ID NO: 484 - RNA, 19 nt, Artificial Sequence
  Synthetic Target Sequence/siNA sense region
ggcucagcccggguacccu

SEQ ID NO: 485 - RNA, 19 nt, Artificial Sequence
  Synthetic Target Sequence/siNA sense region
gaucacuccccugugagga

SEQ ID NO: 486 - RNA, 19 nt, Artificial Sequence
  Synthetic Target Sequence/siNA sense region
gguggucagaucguuggug

SEQ ID NO: 487 - RNA, 19 nt, Artificial Sequence
  Synthetic Target Sequence/siNA sense region
gaugaaggcgaaggcgucc

SEQ ID NO: 488 - RNA, 19 nt, Artificial Sequence
  Synthetic Target Sequence/siNA sense region
aggauggcuccugucaccc

SEQ ID NO: 489 - RNA, 19 nt, Artificial Sequence
  Synthetic Target Sequence/siNA sense region
cucagcccggguacccuug

SEQ ID NO: 490 - RNA, 19 nt, Artificial Sequence
  Synthetic Target Sequence/siNA sense region
ucagcccggguacccuugg

SEQ ID NO: 491 - RNA, 19 nt, Artificial Sequence
  Synthetic Target Sequence/siNA sense region
augaaggcgaaggcgucca

SEQ ID NO: 492 - RNA, 19 nt, Artificial Sequence
  Synthetic Target Sequence/siNA sense region
cgggggagacauauaucac

SEQ ID NO: 493 - RNA, 19 nt, Artificial Sequence
  Synthetic Target Sequence/siNA sense region
caggauggcuccugucacc

SEQ ID NO: 494 - RNA, 19 nt, Artificial Sequence
  Synthetic Target Sequence/siNA sense region
ugaaggcgaaggcguccac

SEQ ID NO: 495 - RNA, 19 nt, Artificial Sequence
  Synthetic Target Sequence/siNA sense region
uggucagaucguuggugga

SEQ ID NO: 496 - RNA, 19 nt, Artificial Sequence
  Synthetic Target Sequence/siNA sense region
gcucagcccggguacccuu

SEQ ID NO: 497 - RNA, 19 nt, Artificial Sequence
  Synthetic Target Sequence/siNA sense region
guggucagaucguuggugg

SEQ ID NO: 498 - RNA, 19 nt, Artificial Sequence
  Synthetic Target Sequence/siNA sense region
cagccuccaggaccccccc

SEQ ID NO: 499 - RNA, 19 nt, Artificial Sequence
  Synthetic Target Sequence/siNA sense region
ggcgguggucagaucguug

SEQ ID NO: 500 - RNA, 19 nt, Artificial Sequence
  Synthetic Target Sequence/siNA sense region
gccuccaggacccccccuc

SEQ ID NO: 501 - RNA, 19 nt, Artificial Sequence
  Synthetic Target Sequence/siNA sense region
aaccggcugauagcguucg

SEQ ID NO: 502 - RNA, 19 nt, Artificial Sequence
  Synthetic Target Sequence/siNA sense region
agccuccaggacccccccu

SEQ ID NO: 503 - RNA, 19 nt, Artificial Sequence
  Synthetic Target Sequence/siNA sense region
cggcuucgccgaccucaug

SEQ ID NO: 504 - RNA, 19 nt, Artificial Sequence
  Synthetic Target Sequence/siNA sense region
gcggagacggcuggagcgc

SEQ ID NO: 505 - RNA, 19 nt, Artificial Sequence
  Synthetic Target Sequence/siNA sense region
ucaugggguacauuccgcu

SEQ ID NO: 506 - RNA, 19 nt, Artificial Sequence
  Synthetic Target Sequence/siNA sense region
gaaccggcugauagcguuc

SEQ ID NO: 507 - RNA, 19 nt, Artificial Sequence
  Synthetic Target Sequence/siNA sense region
gcgguggucagaucguugg

SEQ ID NO: 508 - RNA, 19 nt, Artificial Sequence
  Synthetic Target Sequence/siNA sense region
ggcaggauggcuccuguca

SEQ ID NO: 509 - RNA, 19 nt, Artificial Sequence
  Synthetic Target Sequence/siNA sense region
gcaggauggcuccugucac

SEQ ID NO: 510 - RNA, 19 nt, Artificial Sequence
  Synthetic Target Sequence/siNA sense region
auuuggguaaggucaucga

SEQ ID NO: 511 - RNA, 19 nt, Artificial Sequence
  Synthetic Target Sequence/siNA sense region
accggcugauagcguucgc

SEQ ID NO: 512 - RNA, 19 nt, Artificial Sequence
  Synthetic Target Sequence/siNA sense region
cggagacggcuggagcgcg

SEQ ID NO: 513 - RNA, 19 nt, Artificial Sequence
  Synthetic Target Sequence/siNA sense region
gcggcuucgccgaccucau

SEQ ID NO: 514 - RNA, 19 nt, Artificial Sequence
  Synthetic Target Sequence/siNA sense region
aauuuggguaaggucaucg

SEQ ID NO: 515 - RNA, 19 nt, Artificial Sequence
  Synthetic Target Sequence/siNA sense region
gggcgguggucagaucguu

SEQ ID NO: 516 - RNA, 19 nt, Artificial Sequence
  Synthetic Target Sequence/siNA sense region
caaccgccgcccacaggac

SEQ ID NO: 517 - RNA, 19 nt, Artificial Sequence
  Synthetic Target Sequence/siNA sense region
ugcggcuucgccgaccuca

SEQ ID NO: 518 - RNA, 19 nt, Artificial Sequence
  Synthetic Target Sequence/siNA sense region
cgguggucagaucguuggu

SEQ ID NO: 519 - RNA, 19 nt, Artificial Sequence
  Synthetic Target Sequence/siNA sense region
uugggugugcgcgcgacua

SEQ ID NO: 520 - RNA, 19 nt, Artificial Sequence
  Synthetic Target Sequence/siNA sense region
gugugcgcgcgacuaggaa

SEQ ID NO: 521 - RNA, 19 nt, Artificial Sequence
  Synthetic Target Sequence/siNA sense region
gauggcuccugucaccccg

SEQ ID NO: 522 - RNA, 19 nt, Artificial Sequence
  Synthetic Target Sequence/siNA sense region
ggauggcuccugucacccc

SEQ ID NO: 523 - RNA, 19 nt, Artificial Sequence
  Synthetic Target Sequence/siNA sense region
ugugcgcgcgacuaggaag

SEQ ID NO: 524 - RNA, 19 nt, Artificial Sequence
  Synthetic Target Sequence/siNA sense region
ugggugugcgcgcgacuag

SEQ ID NO: 525 - RNA, 19 nt, Artificial Sequence
  Synthetic Target Sequence/siNA sense region
ggugugcgcgcgacuagga

SEQ ID NO: 526 - RNA, 19 nt, Artificial Sequence
  Synthetic Target Sequence/siNA sense region
gggugugcgcgcgacuagg

SEQ ID NO: 527 - RNA, 19 nt, Artificial Sequence
  Synthetic Target Sequence/siNA sense region
ccccggcguaggucgcgua

SEQ ID NO: 528 - RNA, 19 nt, Artificial Sequence
  Synthetic Target Sequence/siNA sense region
gaaggcgacaaccuauccc

SEQ ID NO: 529 - RNA, 19 nt, Artificial Sequence
  Synthetic Target Sequence/siNA sense region
cccggcguaggucgcguaa

SEQ ID NO: 530 - RNA, 19 nt, Artificial Sequence
  Synthetic Target Sequence/siNA sense region
agcggagacggcuggagcg

SEQ ID NO: 531 - RNA, 19 nt, Artificial Sequence
  Synthetic Target Sequence/siNA sense region
cccccggcguaggucgcgu

SEQ ID NO: 532 - RNA, 19 nt, Artificial Sequence
  Synthetic Target Sequence/siNA sense region
aggcgaaggcguccacagu

SEQ ID NO: 533 - RNA, 19 nt, Artificial Sequence
  Synthetic Target Sequence/siNA sense region
aaggcgaaggcguccacag

SEQ ID NO: 534 - RNA, 19 nt, Artificial Sequence
  Synthetic Target Sequence/siNA sense region
guugggugugcgcgcgacu

SEQ ID NO: 535 - RNA, 19 nt, Artificial Sequence
  Synthetic Target Sequence/siNA sense region
cucaugggguacauuccgc

SEQ ID NO: 536 - RNA, 19 nt, Artificial Sequence
  Synthetic Target Sequence/siNA sense region
ggaaggcgacaaccuaucc

SEQ ID NO: 537 - RNA, 19 nt, Artificial Sequence
  Synthetic Target Sequence/siNA sense region
gcaaguuccuugccgacgg

SEQ ID NO: 538 - RNA, 19 nt, Artificial Sequence
  Synthetic Target Sequence/siNA sense region
ugcagccuccaggaccccc

SEQ ID NO: 539 - RNA, 19 nt, Artificial Sequence
  Synthetic Target Sequence/siNA sense region
ggacugcacgaugcucgug

SEQ ID NO: 540 - RNA, 19 nt, Artificial Sequence
  Synthetic Target Sequence/siNA sense region
gaaggcgaaggcguccaca

SEQ ID NO: 541 - RNA, 19 nt, Artificial Sequence
  Synthetic Target Sequence/siNA sense region
gcaaccucguggaaggcga

SEQ ID NO: 542 - RNA, 19 nt, Artificial Sequence
  Synthetic Target Sequence/siNA sense region
gacgcgggcugugcuuggu

SEQ ID NO: 543 - RNA, 19 nt, Artificial Sequence
  Synthetic Target Sequence/siNA sense region
acgcgggcugugcuuggua

SEQ ID NO: 544 - RNA, 19 nt, Artificial Sequence
  Synthetic Target Sequence/siNA sense region
gugcagccuccaggacccc

SEQ ID NO: 545 - RNA, 19 nt, Artificial Sequence
  Synthetic Target Sequence/siNA sense region
gcagccuccaggacccccc

SEQ ID NO: 546 - RNA, 19 nt, Artificial Sequence
  Synthetic Target Sequence/siNA sense region
cgcaaccucguggaaggcg

SEQ ID NO: 547 - RNA, 19 nt, Artificial Sequence
  Synthetic Target Sequence/siNA sense region
ugucgugcagccuccagga

SEQ ID NO: 548 - RNA, 19 nt, Artificial Sequence
  Synthetic Target Sequence/siNA sense region
auggcuugggauaugauga

SEQ ID NO: 549 - RNA, 19 nt, Artificial Sequence
  Synthetic Target Sequence/siNA sense region
cuugggauaugaugaugaa

SEQ ID NO: 550 - RNA, 19 nt, Artificial Sequence
  Synthetic Target Sequence/siNA sense region
cccuuggccccucuauggc

SEQ ID NO: 551 - RNA, 19 nt, Artificial Sequence
  Synthetic Target Sequence/siNA sense region
uggcuugggauaugaugau

SEQ ID NO: 552 - RNA, 19 nt, Artificial Sequence
  Synthetic Target Sequence/siNA sense region
cugugcaguggaugaaccg

SEQ ID NO: 553 - RNA, 19 nt, Artificial Sequence
  Synthetic Target Sequence/siNA sense region
augacgcgggcugugcuug

SEQ ID NO: 554 - RNA, 19 nt, Artificial Sequence
  Synthetic Target Sequence/siNA sense region
gcuugggauaugaugauga

SEQ ID NO: 555 - RNA, 19 nt, Artificial Sequence
  Synthetic Target Sequence/siNA sense region
uaugacgcgggcugugcuu

SEQ ID NO: 556 - RNA, 19 nt, Artificial Sequence
  Synthetic Target Sequence/siNA sense region
ugacgcgggcugugcuugg

SEQ ID NO: 557 - RNA, 19 nt, Artificial Sequence
  Synthetic Target Sequence/siNA sense region
ggcuugggauaugaugaug

SEQ ID NO: 558 - RNA, 19 nt, Artificial Sequence
  Synthetic Target Sequence/siNA sense region
ugugcaguggaugaaccgg

SEQ ID NO: 559 - RNA, 19 nt, Artificial Sequence
  Synthetic Target Sequence/siNA sense region
gcugugcaguggaugaacc

SEQ ID NO: 560 - RNA, 19 nt, Artificial Sequence
  Synthetic Target Sequence/siNA sense region
cucuucaacugggcaguaa

SEQ ID NO: 561 - RNA, 19 nt, Artificial Sequence
  Synthetic Target Sequence/siNA sense region
ccucguggaaggcgacaac

SEQ ID NO: 562 - RNA, 19 nt, Artificial Sequence
  Synthetic Target Sequence/siNA sense region
ugugucacccagacagucg

SEQ ID NO: 563 - RNA, 19 nt, Artificial Sequence
  Synthetic Target Sequence/siNA sense region
ggcgugaacuaugcaacag

SEQ ID NO: 564 - RNA, 19 nt, Artificial Sequence
  Synthetic Target Sequence/siNA sense region
cggcgugaacuaugcaaca

SEQ ID NO: 565 - RNA, 19 nt, Artificial Sequence
  Synthetic Target Sequence/siNA sense region
gugucacccagacagucga

SEQ ID NO: 566 - RNA, 19 nt, Artificial Sequence
  Synthetic Target Sequence/siNA sense region
ccucuucaacugggcagua

SEQ ID NO: 567 - RNA, 19 nt, Artificial Sequence
  Synthetic Target Sequence/siNA sense region
cguggaaggcgacaaccua

SEQ ID NO: 568 - RNA, 19 nt, Artificial Sequence
  Synthetic Target Sequence/siNA sense region
ucguggaaggcgacaaccu

SEQ ID NO: 569 - RNA, 19 nt, Artificial Sequence
  Synthetic Target Sequence/siNA sense region
cggccuaguuggggcccca

SEQ ID NO: 570 - RNA, 19 nt, Artificial Sequence
  Synthetic Target Sequence/siNA sense region
cgacuaggaagacuuccga

SEQ ID NO: 571 - RNA, 19 nt, Artificial Sequence
  Synthetic Target Sequence/siNA sense region
uuuggguaaggucaucgau

SEQ ID NO: 572 - RNA, 19 nt, Artificial Sequence
  Synthetic Target Sequence/siNA sense region
guggaaggcgacaaccuau

SEQ ID NO: 573 - RNA, 19 nt, Artificial Sequence
  Synthetic Target Sequence/siNA sense region
accucguggaaggcgacaa

SEQ ID NO: 574 - RNA, 19 nt, Artificial Sequence
  Synthetic Target Sequence/siNA sense region
gcgacuaggaagacuuccg

SEQ ID NO: 575 - RNA, 19 nt, Artificial Sequence
  Synthetic Target Sequence/siNA sense region
gucgugcagccuccaggac

SEQ ID NO: 576 - RNA, 19 nt, Artificial Sequence
  Synthetic Target Sequence/siNA sense region
uaggaagacuuccgagcgg

SEQ ID NO: 577 - RNA, 19 nt, Artificial Sequence
  Synthetic Target Sequence/siNA sense region
acggcgugaacuaugcaac

SEQ ID NO: 578 - RNA, 19 nt, Artificial Sequence
  Synthetic Target Sequence/siNA sense region
cucguggaaggcgacaacc

SEQ ID NO: 579 - RNA, 19 nt, Artificial Sequence
  Synthetic Target Sequence/siNA sense region
ggucgcaaccucguggaag

SEQ ID NO: 580 - RNA, 19 nt, Artificial Sequence
  Synthetic Target Sequence/siNA sense region
cggucgcaaccucguggaa

SEQ ID NO: 581 - RNA, 19 nt, Artificial Sequence
  Synthetic Target Sequence/siNA sense region
gcgcgcgacuaggaagacu

SEQ ID NO: 582 - RNA, 19 nt, Artificial Sequence
  Synthetic Target Sequence/siNA sense region
gacggcgugaacuaugcaa

SEQ ID NO: 583 - RNA, 19 nt, Artificial Sequence
  Synthetic Target Sequence/siNA sense region
uagaucacuccccugugag

SEQ ID NO: 584 - RNA, 19 nt, Artificial Sequence
  Synthetic Target Sequence/siNA sense region
agcggucgcaaccucgugg

SEQ ID NO: 585 - RNA, 19 nt, Artificial Sequence
  Synthetic Target Sequence/siNA sense region
uggaaggcgacaaccuauc

SEQ ID NO: 586 - RNA, 19 nt, Artificial Sequence
  Synthetic Target Sequence/siNA sense region
cgcgcgacuaggaagacuu

SEQ ID NO: 587 - RNA, 19 nt, Artificial Sequence
  Synthetic Target Sequence/siNA sense region
cuaggaagacuuccgagcg

SEQ ID NO: 588 - RNA, 19 nt, Artificial Sequence
  Synthetic Target Sequence/siNA sense region
gugcgcgcgacuaggaaga

SEQ ID NO: 589 - RNA, 19 nt, Artificial Sequence
  Synthetic Target Sequence/siNA sense region
agaucacuccccugugagg

SEQ ID NO: 590 - RNA, 19 nt, Artificial Sequence
  Synthetic Target Sequence/siNA sense region
ugcgcgcgacuaggaagac

SEQ ID NO: 591 - RNA, 19 nt, Artificial Sequence
  Synthetic Target Sequence/siNA sense region
auagaucacuccccuguga

SEQ ID NO: 592 - RNA, 19 nt, Artificial Sequence
  Synthetic Target Sequence/siNA sense region
gagcggucgcaaccucgug

SEQ ID NO: 593 - RNA, 19 nt, Artificial Sequence
  Synthetic Target Sequence/siNA sense region
cacgaacgacugcuccaac

SEQ ID NO: 594 - RNA, 19 nt, Artificial Sequence
  Synthetic Target Sequence/siNA sense region
ggcaaguuccuugccgacg

SEQ ID NO: 595 - RNA, 19 nt, Artificial Sequence
  Synthetic Target Sequence/siNA sense region
ucgugcagccuccaggacc

SEQ ID NO: 596 - RNA, 19 nt, Artificial Sequence
  Synthetic Target Sequence/siNA sense region
gucacgaacgacugcucca

SEQ ID NO: 597 - RNA, 19 nt, Artificial Sequence
  Synthetic Target Sequence/siNA sense region
gcggucgcaaccucgugga

SEQ ID NO: 598 - RNA, 19 nt, Artificial Sequence
  Synthetic Target Sequence/siNA sense region
gcgcgacuaggaagacuuc

SEQ ID NO: 599 - RNA, 19 nt, Artificial Sequence
  Synthetic Target Sequence/siNA sense region
gcuaugacgcgggcugugc

SEQ ID NO: 600 - RNA, 19 nt, Artificial Sequence
  Synthetic Target Sequence/siNA sense region
ucacgaacgacugcuccaa

SEQ ID NO: 601 - RNA, 19 nt, Artificial Sequence
  Synthetic Target Sequence/siNA sense region
ucgcaaccucguggaaggc

SEQ ID NO: 602 - RNA, 19 nt, Artificial Sequence
  Synthetic Target Sequence/siNA sense region
cgugcagccuccaggaccc

SEQ ID NO: 603 - RNA, 19 nt, Artificial Sequence
  Synthetic Target Sequence/siNA sense region
gucgcaaccucguggaagg

SEQ ID NO: 604 - RNA, 19 nt, Artificial Sequence
  Synthetic Target Sequence/siNA sense region
acuaggaagacuuccgagc

SEQ ID NO: 605 - RNA, 19 nt, Artificial Sequence
  Synthetic Target Sequence/siNA sense region
cgcgacuaggaagacuucc

SEQ ID NO: 606 - RNA, 19 nt, Artificial Sequence
  Synthetic Target Sequence/siNA sense region
ugggcgaagcacaugugga

SEQ ID NO: 607 - RNA, 19 nt, Artificial Sequence
  Synthetic Target Sequence/siNA sense region
ccuugccuacuauuccaug

SEQ ID NO: 608 - RNA, 19 nt, Artificial Sequence
  Synthetic Target Sequence/siNA sense region
gccucaggaaacuuggggu

SEQ ID NO: 609 - RNA, 19 nt, Artificial Sequence
  Synthetic Target Sequence/siNA sense region
ugcuaugacgcgggcugug

SEQ ID NO: 610 - RNA, 19 nt, Artificial Sequence
  Synthetic Target Sequence/siNA sense region
ucgugcucgccaccgcuac

SEQ ID NO: 611 - RNA, 19 nt, Artificial Sequence
  Synthetic Target Sequence/siNA sense region
ugccucaggaaacuugggg

SEQ ID NO: 612 - RNA, 19 nt, Artificial Sequence
  Synthetic Target Sequence/siNA sense region
ugucucgugcccgaccccg

SEQ ID NO: 613 - RNA, 19 nt, Artificial Sequence
  Synthetic Target Sequence/siNA sense region
uguggcggcaggagauggg

SEQ ID NO: 614 - RNA, 19 nt, Artificial Sequence
  Synthetic Target Sequence/siNA sense region
gucgugcucgccaccgcua

SEQ ID NO: 615 - RNA, 19 nt, Artificial Sequence
  Synthetic Target Sequence/siNA sense region
gauuuccacuacgugacgg

SEQ ID NO: 616 - RNA, 19 nt, Artificial Sequence
  Synthetic Target Sequence/siNA sense region
gggccuugccuacuauucc

SEQ ID NO: 617 - RNA, 19 nt, Artificial Sequence
  Synthetic Target Sequence/siNA sense region
gccuugccuacuauuccau

SEQ ID NO: 618 - RNA, 19 nt, Artificial Sequence
  Synthetic Target Sequence/siNA sense region
gacuaggaagacuuccgag

SEQ ID NO: 619 - RNA, 19 nt, Artificial Sequence
  Synthetic Target Sequence/siNA sense region
gcgggggagacauauauca

SEQ ID NO: 620 - RNA, 19 nt, Artificial Sequence
  Synthetic Target Sequence/siNA sense region
cgagcggucgcaaccucgu

SEQ ID NO: 621 - RNA, 19 nt, Artificial Sequence
  Synthetic Target Sequence/siNA sense region
ggccuugccuacuauucca

SEQ ID NO: 622 - RNA, 19 nt, Artificial Sequence
  Synthetic Target Sequence/siNA sense region
auuuccacuacgugacggg

SEQ ID NO: 623 - RNA, 19 nt, Artificial Sequence
  Synthetic Target Sequence/siNA sense region
ggacgucaaguucccgggc

SEQ ID NO: 624 - RNA, 19 nt, Artificial Sequence
  Synthetic Target Sequence/siNA sense region
gagugcuaugacgcgggcu

SEQ ID NO: 625 - RNA, 19 nt, Artificial Sequence
  Synthetic Target Sequence/siNA sense region
gacgucaaguucccgggcg

SEQ ID NO: 626 - RNA, 19 nt, Artificial Sequence
  Synthetic Target Sequence/siNA sense region
ucagcgacgggucuugguc

SEQ ID NO: 627 - RNA, 19 nt, Artificial Sequence
  Synthetic Target Sequence/siNA sense region
ucaaguucccgggcggugg

SEQ ID NO: 628 - RNA, 19 nt, Artificial Sequence
  Synthetic Target Sequence/siNA sense region
ucaaggagaugaaggcgaa

SEQ ID NO: 629 - RNA, 19 nt, Artificial Sequence
  Synthetic Target Sequence/siNA sense region
ccuauccccaaggcucgcc

SEQ ID NO: 630 - RNA, 19 nt, Artificial Sequence
  Synthetic Target Sequence/siNA sense region
cuugaccuaccucagauca

SEQ ID NO: 631 - RNA, 19 nt, Artificial Sequence
  Synthetic Target Sequence/siNA sense region
uuuccacuacgugacgggc

SEQ ID NO: 632 - RNA, 19 nt, Artificial Sequence
  Synthetic Target Sequence/siNA sense region
agugcuaugacgcgggcug

SEQ ID NO: 633 - RNA, 19 nt, Artificial Sequence
  Synthetic Target Sequence/siNA sense region
acgucaaguucccgggcgg

SEQ ID NO: 634 - RNA, 19 nt, Artificial Sequence
  Synthetic Target Sequence/siNA sense region
ucuggagacaucgggccag

SEQ ID NO: 635 - RNA, 19 nt, Artificial Sequence
  Synthetic Target Sequence/siNA sense region
gggcgaagcacauguggaa

SEQ ID NO: 636 - RNA, 19 nt, Artificial Sequence
  Synthetic Target Sequence/siNA sense region
uugaccuaccucagaucau

SEQ ID NO: 637 - RNA, 19 nt, Artificial Sequence
  Synthetic Target Sequence/siNA sense region
ccaagcggagacggcugga

SEQ ID NO: 638 - RNA, 19 nt, Artificial Sequence
  Synthetic Target Sequence/siNA sense region
accaagcggagacggcugg

SEQ ID NO: 639 - RNA, 19 nt, Artificial Sequence
  Synthetic Target Sequence/siNA sense region
ggguggcuucaugccucag

SEQ ID NO: 640 - RNA, 19 nt, Artificial Sequence
  Synthetic Target Sequence/siNA sense region
gucaaguucccgggcggug

SEQ ID NO: 641 - RNA, 19 nt, Artificial Sequence
  Synthetic Target Sequence/siNA sense region
cucaaggagaugaaggcga

SEQ ID NO: 642 - RNA, 19 nt, Artificial Sequence
  Synthetic Target Sequence/siNA sense region
gaccaagcggagacggcug

SEQ ID NO: 643 - RNA, 19 nt, Artificial Sequence
  Synthetic Target Sequence/siNA sense region
uccaggucgggcucaacca

SEQ ID NO: 644 - RNA, 19 nt, Artificial Sequence
  Synthetic Target Sequence/siNA sense region
cucuuucucuaucuuccuc

SEQ ID NO: 645 - RNA, 19 nt, Artificial Sequence
  Synthetic Target Sequence/siNA sense region
gucuggagacaucgggcca

SEQ ID NO: 646 - RNA, 19 nt, Artificial Sequence
  Synthetic Target Sequence/siNA sense region
guugugacuuggcccccga

SEQ ID NO: 647 - RNA, 19 nt, Artificial Sequence
  Synthetic Target Sequence/siNA sense region
agaccuggcuccaguccaa

SEQ ID NO: 648 - RNA, 19 nt, Artificial Sequence
  Synthetic Target Sequence/siNA sense region
cuugccuacuauuccaugg

SEQ ID NO: 649 - RNA, 19 nt, Artificial Sequence
  Synthetic Target Sequence/siNA sense region
cccgguugcucuuucucua

SEQ ID NO: 650 - RNA, 19 nt, Artificial Sequence
  Synthetic Target Sequence/siNA sense region
cuuucucuaucuuccucuu

SEQ ID NO: 651 - RNA, 19 nt, Artificial Sequence
  Synthetic Target Sequence/siNA sense region
aggguggcuucaugccuca

SEQ ID NO: 652 - RNA, 19 nt, Artificial Sequence
  Synthetic Target Sequence/siNA sense region
aagaccuggcuccagucca

SEQ ID NO: 653 - RNA, 19 nt, Artificial Sequence
  Synthetic Target Sequence/siNA sense region
ccgguugcucuuucucuau

SEQ ID NO: 654 - RNA, 19 nt, Artificial Sequence
  Synthetic Target Sequence/siNA sense region
cgguugcucuuucucuauc

SEQ ID NO: 655 - RNA, 19 nt, Artificial Sequence
  Synthetic Target Sequence/siNA sense region
ugggggauuuccacuacgu

SEQ ID NO: 656 - RNA, 19 nt, Artificial Sequence
  Synthetic Target Sequence/siNA sense region
augucacgaacgacugcuc

SEQ ID NO: 657 - RNA, 19 nt, Artificial Sequence
  Synthetic Target Sequence/siNA sense region
ggccuaguuggggccccac

SEQ ID NO: 658 - RNA, 19 nt, Artificial Sequence
  Synthetic Target Sequence/siNA sense region
uggaccaagcggagacggc

SEQ ID NO: 659 - RNA, 19 nt, Artificial Sequence
  Synthetic Target Sequence/siNA sense region
uuccaggucgggcucaacc

SEQ ID NO: 660 - RNA, 19 nt, Artificial Sequence
  Synthetic Target Sequence/siNA sense region
agcgggucgaguuccuggu

SEQ ID NO: 661 - RNA, 19 nt, Artificial Sequence
  Synthetic Target Sequence/siNA sense region
caaggagaugaaggcgaag

SEQ ID NO: 662 - RNA, 19 nt, Artificial Sequence
  Synthetic Target Sequence/siNA sense region
caugucacgaacgacugcu

SEQ ID NO: 663 - RNA, 19 nt, Artificial Sequence
  Synthetic Target Sequence/siNA sense region
cagcgggucgaguuccugg

SEQ ID NO: 664 - RNA, 19 nt, Artificial Sequence
  Synthetic Target Sequence/siNA sense region
uuccacuacgugacgggca

SEQ ID NO: 665 - RNA, 19 nt, Artificial Sequence
  Synthetic Target Sequence/siNA sense region
uaggguggcuucaugccuc

SEQ ID NO: 666 - RNA, 19 nt, Artificial Sequence
  Synthetic Target Sequence/siNA sense region
uccaggacugcacgaugcu

SEQ ID NO: 667 - RNA, 19 nt, Artificial Sequence
  Synthetic Target Sequence/siNA sense region
uccacuacgugacgggcau

SEQ ID NO: 668 - RNA, 19 nt, Artificial Sequence
  Synthetic Target Sequence/siNA sense region
aauaggguggcuucaugcc

SEQ ID NO: 669 - RNA, 19 nt, Artificial Sequence
  Synthetic Target Sequence/siNA sense region
gucuucacggaggcuauga

SEQ ID NO: 670 - RNA, 19 nt, Artificial Sequence
  Synthetic Target Sequence/siNA sense region
auaggguggcuucaugccu

SEQ ID NO: 671 - RNA, 19 nt, Artificial Sequence
  Synthetic Target Sequence/siNA sense region
ucuucacggaggcuaugac

SEQ ID NO: 672 - RNA, 19 nt, Artificial Sequence
  Synthetic Target Sequence/siNA sense region
augccucaggaaacuuggg

SEQ ID NO: 673 - RNA, 19 nt, Artificial Sequence
  Synthetic Target Sequence/siNA sense region
accgggacgugcucaagga

SEQ ID NO: 674 - RNA, 19 nt, Artificial Sequence
  Synthetic Target Sequence/siNA sense region
ggggcugugcaguggauga

SEQ ID NO: 675 - RNA, 19 nt, Artificial Sequence
  Synthetic Target Sequence/siNA sense region
aagcuccaggacugcacga

SEQ ID NO: 676 - RNA, 19 nt, Artificial Sequence
  Synthetic Target Sequence/siNA sense region
gcuccaggacugcacgaug

SEQ ID NO: 677 - RNA, 19 nt, Artificial Sequence
  Synthetic Target Sequence/siNA sense region
uaccgggacgugcucaagg

SEQ ID NO: 678 - RNA, 19 nt, Artificial Sequence
  Synthetic Target Sequence/siNA sense region
gggcugugcaguggaugaa

SEQ ID NO: 679 - RNA, 19 nt, Artificial Sequence
  Synthetic Target Sequence/siNA sense region
cgucaaguucccgggcggu

SEQ ID NO: 680 - RNA, 19 nt, Artificial Sequence
  Synthetic Target Sequence/siNA sense region
ucaauaggguggcuucaug

SEQ ID NO: 681 - RNA, 19 nt, Artificial Sequence
  Synthetic Target Sequence/siNA sense region
agucuucacggaggcuaug

SEQ ID NO: 682 - RNA, 19 nt, Artificial Sequence
  Synthetic Target Sequence/siNA sense region
ggaccaagcggagacggcu

SEQ ID NO: 683 - RNA, 19 nt, Artificial Sequence
  Synthetic Target Sequence/siNA sense region
ggcuccaguccaagcuccu

SEQ ID NO: 684 - RNA, 19 nt, Artificial Sequence
  Synthetic Target Sequence/siNA sense region
ggcugugcaguggaugaac

SEQ ID NO: 685 - RNA, 19 nt, Artificial Sequence
  Synthetic Target Sequence/siNA sense region
cuccaggacugcacgaugc

SEQ ID NO: 686 - RNA, 19 nt, Artificial Sequence
  Synthetic Target Sequence/siNA sense region
gagucuucacggaggcuau

SEQ ID NO: 687 - RNA, 19 nt, Artificial Sequence
  Synthetic Target Sequence/siNA sense region
uggcuccaguccaagcucc

SEQ ID NO: 688 - RNA, 19 nt, Artificial Sequence
  Synthetic Target Sequence/siNA sense region
ggggauuuccacuacguga

SEQ ID NO: 689 - RNA, 19 nt, Artificial Sequence
  Synthetic Target Sequence/siNA sense region
caugccucaggaaacuugg

SEQ ID NO: 690 - RNA, 19 nt, Artificial Sequence
  Synthetic Target Sequence/siNA sense region
aucaauaggguggcuucau

SEQ ID NO: 691 - RNA, 19 nt, Artificial Sequence
  Synthetic Target Sequence/siNA sense region
gcgggccuugccuacuauu

SEQ ID NO: 692 - RNA, 19 nt, Artificial Sequence
  Synthetic Target Sequence/siNA sense region
ccgggacgugcucaaggag

SEQ ID NO: 693 - RNA, 19 nt, Artificial Sequence
  Synthetic Target Sequence/siNA sense region
ccaugguggggaacugggc

SEQ ID NO: 694 - RNA, 19 nt, Artificial Sequence
  Synthetic Target Sequence/siNA sense region
caauaggguggcuucaugc

SEQ ID NO: 695 - RNA, 19 nt, Artificial Sequence
  Synthetic Target Sequence/siNA sense region
agcuccaggacugcacgau

SEQ ID NO: 696 - RNA, 19 nt, Artificial Sequence
  Synthetic Target Sequence/siNA sense region
cgggccuugccuacuauuc

SEQ ID NO: 697 - RNA, 19 nt, Artificial Sequence
  Synthetic siNA antisense region
cuacgagaccucccggggc

SEQ ID NO: 698 - RNA, 19 nt, Artificial Sequence
  Synthetic siNA antisense region
ccuaucaggcaguaccaca

SEQ ID NO: 699 - RNA, 19 nt, Artificial Sequence
  Synthetic siNA antisense region
cuaucaggcaguaccacaa

SEQ ID NO: 700 - RNA, 19 nt, Artificial Sequence
  Synthetic siNA antisense region
ucuacgagaccucccgggg

SEQ ID NO: 701 - RNA, 19 nt, Artificial Sequence
  Synthetic siNA antisense region
cccuaucaggcaguaccac

SEQ ID NO: 702 - RNA, 19 nt, Artificial Sequence
  Synthetic siNA antisense region
caagcacccuaucaggcag

SEQ ID NO: 703 - RNA, 19 nt, Artificial Sequence
  Synthetic siNA antisense region
aucaggcaguaccacaagg

SEQ ID NO: 704 - RNA, 19 nt, Artificial Sequence
  Synthetic siNA antisense region
guaccacaaggccuuucgc

SEQ ID NO: 705 - RNA, 19 nt, Artificial Sequence
  Synthetic siNA antisense region
agcacccuaucaggcagua

SEQ ID NO: 706 - RNA, 19 nt, Artificial Sequence
  Synthetic siNA antisense region
cacccuaucaggcaguacc

SEQ ID NO: 707 - RNA, 19 nt, Artificial Sequence
  Synthetic siNA antisense region
gcaguaccacaaggccuuu

SEQ ID NO: 708 - RNA, 19 nt, Artificial Sequence
  Synthetic siNA antisense region
ggcaguaccacaaggccuu

SEQ ID NO: 709 - RNA, 19 nt, Artificial Sequence
  Synthetic siNA antisense region
uaucaggcaguaccacaag

SEQ ID NO: 710 - RNA, 19 nt, Artificial Sequence
  Synthetic siNA antisense region
aggcaguaccacaaggccu

SEQ ID NO: 711 - RNA, 19 nt, Artificial Sequence
  Synthetic siNA antisense region
gcacccuaucaggcaguac

SEQ ID NO: 712 - RNA, 19 nt, Artificial Sequence
  Synthetic siNA antisense region
aagcacccuaucaggcagu

SEQ ID NO: 713 - RNA, 19 nt, Artificial Sequence
  Synthetic siNA antisense region
cucccggggcacucgcaag

SEQ ID NO: 714 - RNA, 19 nt, Artificial Sequence
  Synthetic siNA antisense region
cucgcaagcacccuaucag

SEQ ID NO: 715 - RNA, 19 nt, Artificial Sequence
  Synthetic siNA antisense region
ccucccggggcacucgcaa

SEQ ID NO: 716 - RNA, 19 nt, Artificial Sequence
  Synthetic siNA antisense region
ucgcaagcacccuaucagg

SEQ ID NO: 717 - RNA, 19 nt, Artificial Sequence
  Synthetic siNA antisense region
caggcaguaccacaaggcc

SEQ ID NO: 718 - RNA, 19 nt, Artificial Sequence
  Synthetic siNA antisense region
ucccggggcacucgcaagc

SEQ ID NO: 719 - RNA, 19 nt, Artificial Sequence
  Synthetic siNA antisense region
gcaagcacccuaucaggca

SEQ ID NO: 720 - RNA, 19 nt, Artificial Sequence
  Synthetic siNA antisense region
caguaccacaaggccuuuc

SEQ ID NO: 721 - RNA, 19 nt, Artificial Sequence
  Synthetic siNA antisense region
cgcaagcacccuaucaggc

SEQ ID NO: 722 - RNA, 19 nt, Artificial Sequence
  Synthetic siNA antisense region
aguaccacaaggccuuucg

SEQ ID NO: 723 - RNA, 19 nt, Artificial Sequence
  Synthetic siNA antisense region
ucaggcaguaccacaaggc

SEQ ID NO: 724 - RNA, 19 nt, Artificial Sequence
  Synthetic siNA antisense region
gagaccucccggggcacuc

SEQ ID NO: 725 - RNA, 19 nt, Artificial Sequence
  Synthetic siNA antisense region
gucuacgagaccucccggg

SEQ ID NO: 726 - RNA, 19 nt, Artificial Sequence
  Synthetic siNA antisense region
accucccggggcacucgca

SEQ ID NO: 727 - RNA, 19 nt, Artificial Sequence
  Synthetic siNA antisense region
acccuaucaggcaguacca

SEQ ID NO: 728 - RNA, 19 nt, Artificial Sequence
  Synthetic siNA antisense region
auuccgguguacucaccgg

SEQ ID NO: 729 - RNA, 19 nt, Artificial Sequence
  Synthetic siNA antisense region
gaccucccggggcacucgc

SEQ ID NO: 730 - RNA, 19 nt, Artificial Sequence
  Synthetic siNA antisense region
agaccucccggggcacucg

SEQ ID NO: 731 - RNA, 19 nt, Artificial Sequence
  Synthetic siNA antisense region
uacgagaccucccggggca

SEQ ID NO: 732 - RNA, 19 nt, Artificial Sequence
  Synthetic siNA antisense region
acgagaccucccggggcac

SEQ ID NO: 733 - RNA, 19 nt, Artificial Sequence
  Synthetic siNA antisense region
cgagaccucccggggcacu

SEQ ID NO: 734 - RNA, 19 nt, Artificial Sequence
  Synthetic siNA antisense region
ggucuacgagaccucccgg

SEQ ID NO: 735 - RNA, 19 nt, Artificial Sequence
  Synthetic siNA antisense region
acucgcaagcacccuauca

SEQ ID NO: 736 - RNA, 19 nt, Artificial Sequence
  Synthetic siNA antisense region
ccggggcacucgcaagcac

SEQ ID NO: 737 - RNA, 19 nt, Artificial Sequence
  Synthetic siNA antisense region
gcacucgcaagcacccuau

SEQ ID NO: 738 - RNA, 19 nt, Artificial Sequence
  Synthetic siNA antisense region
ggggcacucgcaagcaccc

SEQ ID NO: 739 - RNA, 19 nt, Artificial Sequence
  Synthetic siNA antisense region
cggucuacgagaccucccg

SEQ ID NO: 740 - RNA, 19 nt, Artificial Sequence
  Synthetic siNA antisense region
acggucuacgagaccuccc

SEQ ID NO: 741 - RNA, 19 nt, Artificial Sequence
  Synthetic siNA antisense region
cacucgcaagcacccuauc

SEQ ID NO: 742 - RNA, 19 nt, Artificial Sequence
  Synthetic siNA antisense region
cacggucuacgagaccucc

SEQ ID NO: 743 - RNA, 19 nt, Artificial Sequence
  Synthetic siNA antisense region
gggcacucgcaagcacccu

SEQ ID NO: 744 - RNA, 19 nt, Artificial Sequence
  Synthetic siNA antisense region
cccggggcacucgcaagca

SEQ ID NO: 745 - RNA, 19 nt, Artificial Sequence
  Synthetic siNA antisense region
cggggcacucgcaagcacc

SEQ ID NO: 746 - RNA, 19 nt, Artificial Sequence
  Synthetic siNA antisense region
ggcacucgcaagcacccua

SEQ ID NO: 747 - RNA, 19 nt, Artificial Sequence
  Synthetic siNA antisense region
ugcacggucuacgagaccu

SEQ ID NO: 748 - RNA, 19 nt, Artificial Sequence
  Synthetic siNA antisense region
gcacggucuacgagaccuc

SEQ ID NO: 749 - RNA, 19 nt, Artificial Sequence
  Synthetic siNA antisense region
cgguguacucaccgguucc

SEQ ID NO: 750 - RNA, 19 nt, Artificial Sequence
  Synthetic siNA antisense region
gguguacucaccgguuccg

SEQ ID NO: 751 - RNA, 19 nt, Artificial Sequence
  Synthetic siNA antisense region
aauuccgguguacucaccg

SEQ ID NO: 752 - RNA, 19 nt, Artificial Sequence
  Synthetic siNA antisense region
guguacucaccgguuccgc

SEQ ID NO: 753 - RNA, 19 nt, Artificial Sequence
  Synthetic siNA antisense region
uccgguguacucaccgguu

SEQ ID NO: 754 - RNA, 19 nt, Artificial Sequence
  Synthetic siNA antisense region
uuccgguguacucaccggu

SEQ ID NO: 755 - RNA, 19 nt, Artificial Sequence
  Synthetic siNA antisense region
guacucaccgguuccgcag

SEQ ID NO: 756 - RNA, 19 nt, Artificial Sequence
  Synthetic siNA antisense region
acucaccgguuccgcagac

SEQ ID NO: 757 - RNA, 19 nt, Artificial Sequence
  Synthetic siNA antisense region
ccgguguacucaccgguuc

SEQ ID NO: 758 - RNA, 19 nt, Artificial Sequence
  Synthetic siNA antisense region
uguacucaccgguuccgca

SEQ ID NO: 759 - RNA, 19 nt, Artificial Sequence
  Synthetic siNA antisense region
uacucaccgguuccgcaga

SEQ ID NO: 760 - RNA, 19 nt, Artificial Sequence
  Synthetic siNA antisense region
agaccacuauggcucuccc

SEQ ID NO: 761 - RNA, 19 nt, Artificial Sequence
  Synthetic siNA antisense region
caccgguuccgcagaccac

SEQ ID NO: 762 - RNA, 19 nt, Artificial Sequence
  Synthetic siNA antisense region
cucaccgguuccgcagacc

SEQ ID NO: 763 - RNA, 19 nt, Artificial Sequence
  Synthetic siNA antisense region
gaccacuauggcucucccg

SEQ ID NO: 764 - RNA, 19 nt, Artificial Sequence
  Synthetic siNA antisense region
accacuauggcucucccgg

SEQ ID NO: 765 - RNA, 19 nt, Artificial Sequence
  Synthetic siNA antisense region
ucaccgguuccgcagacca

SEQ ID NO: 766 - RNA, 19 nt, Artificial Sequence
  Synthetic siNA antisense region
gcaauuccgguguacucac

SEQ ID NO: 767 - RNA, 19 nt, Artificial Sequence
  Synthetic siNA antisense region
ggcaauuccgguguacuca

SEQ ID NO: 768 - RNA, 19 nt, Artificial Sequence
  Synthetic siNA antisense region
caauuccgguguacucacc

SEQ ID NO: 769 - RNA, 19 nt, Artificial Sequence
  Synthetic siNA antisense region
ccgcagaccacuauggcuc

SEQ ID NO: 770 - RNA, 19 nt, Artificial Sequence
  Synthetic siNA antisense region
cgcagaccacuauggcucu

SEQ ID NO: 771 - RNA, 19 nt, Artificial Sequence
  Synthetic siNA antisense region
ccgguuccgcagaccacua

SEQ ID NO: 772 - RNA, 19 nt, Artificial Sequence
  Synthetic siNA antisense region
cgguuccgcagaccacuau

SEQ ID NO: 773 - RNA, 19 nt, Artificial Sequence
  Synthetic siNA antisense region
gcagaccacuauggcucuc

SEQ ID NO: 774 - RNA, 19 nt, Artificial Sequence
  Synthetic siNA antisense region
uuccgcagaccacuauggc

SEQ ID NO: 775 - RNA, 19 nt, Artificial Sequence
  Synthetic siNA antisense region
accgguuccgcagaccacu

SEQ ID NO: 776 - RNA, 19 nt, Artificial Sequence
  Synthetic siNA antisense region
gguuccgcagaccacuaug

SEQ ID NO: 777 - RNA, 19 nt, Artificial Sequence
  Synthetic siNA antisense region
uccgcagaccacuauggcu

SEQ ID NO: 778 - RNA, 19 nt, Artificial Sequence
  Synthetic siNA antisense region
guuccgcagaccacuaugg

SEQ ID NO: 779 - RNA, 19 nt, Artificial Sequence
  Synthetic siNA antisense region
auggcucucccgggagggg

SEQ ID NO: 780 - RNA, 19 nt, Artificial Sequence
  Synthetic siNA antisense region
cagaccacuauggcucucc

SEQ ID NO: 781 - RNA, 19 nt, Artificial Sequence
  Synthetic siNA antisense region
ccacuauggcucucccggg

SEQ ID NO: 782 - RNA, 19 nt, Artificial Sequence
  Synthetic siNA antisense region
uggcucucccgggaggggg

SEQ ID NO: 783 - RNA, 19 nt, Artificial Sequence
  Synthetic siNA antisense region
cacuauggcucucccggga

SEQ ID NO: 784 - RNA, 19 nt, Artificial Sequence
  Synthetic siNA antisense region
ggcucucccgggagggggg

SEQ ID NO: 785 - RNA, 19 nt, Artificial Sequence
  Synthetic siNA antisense region
uauggcucucccgggaggg

SEQ ID NO: 786 - RNA, 19 nt, Artificial Sequence
  Synthetic siNA antisense region
cuauggcucucccgggagg

SEQ ID NO: 787 - RNA, 19 nt, Artificial Sequence
  Synthetic siNA antisense region
acuauggcucucccgggag

SEQ ID NO: 788 - RNA, 19 nt, Artificial Sequence
  Synthetic siNA antisense region
gggccccugcgcggcaaca

SEQ ID NO: 789 - RNA, 19 nt, Artificial Sequence
  Synthetic siNA antisense region
gcucucccgggaggggggg

SEQ ID NO: 790 - RNA, 19 nt, Artificial Sequence
  Synthetic siNA antisense region
cacucauacuaacgccaug

SEQ ID NO: 791 - RNA, 19 nt, Artificial Sequence
  Synthetic siNA antisense region
cauacuaacgccauggcua

SEQ ID NO: 792 - RNA, 19 nt, Artificial Sequence
  Synthetic siNA antisense region
ucauacuaacgccauggcu

SEQ ID NO: 793 - RNA, 19 nt, Artificial Sequence
  Synthetic siNA antisense region
acucauacuaacgccaugg

SEQ ID NO: 794 - RNA, 19 nt, Artificial Sequence
  Synthetic siNA antisense region
acacucauacuaacgccau

SEQ ID NO: 795 - RNA, 19 nt, Artificial Sequence
  Synthetic siNA antisense region
acgccauggcuagacgcuu

SEQ ID NO: 796 - RNA, 19 nt, Artificial Sequence
  Synthetic siNA antisense region
acuaacgccauggcuagac

SEQ ID NO: 797 - RNA, 19 nt, Artificial Sequence
  Synthetic siNA antisense region
cgccauggcuagacgcuuu

SEQ ID NO: 798 - RNA, 19 nt, Artificial Sequence
  Synthetic siNA antisense region
uaacgccauggcuagacgc

SEQ ID NO: 799 - RNA, 19 nt, Artificial Sequence
  Synthetic siNA antisense region
cucauacuaacgccauggc

SEQ ID NO: 800 - RNA, 19 nt, Artificial Sequence
  Synthetic siNA antisense region
aacgccauggcuagacgcu

SEQ ID NO: 801 - RNA, 19 nt, Artificial Sequence
  Synthetic siNA antisense region
cuaacgccauggcuagacg

SEQ ID NO: 802 - RNA, 19 nt, Artificial Sequence
  Synthetic siNA antisense region
uacuaacgccauggcuaga

SEQ ID NO: 803 - RNA, 19 nt, Artificial Sequence
  Synthetic siNA antisense region
gccauggcuagacgcuuuc

SEQ ID NO: 804 - RNA, 19 nt, Artificial Sequence
  Synthetic siNA antisense region
auacuaacgccauggcuag

SEQ ID NO: 805 - RNA, 19 nt, Artificial Sequence
  Synthetic siNA antisense region
aguuccucacaggggagug

SEQ ID NO: 806 - RNA, 19 nt, Artificial Sequence
  Synthetic siNA antisense region
uuugguuuuucuuugaggu

SEQ ID NO: 807 - RNA, 19 nt, Artificial Sequence
  Synthetic siNA antisense region
uggcuagacgcuuucugcg

SEQ ID NO: 808 - RNA, 19 nt, Artificial Sequence
  Synthetic siNA antisense region
gguaucgaugaccuuaccc

SEQ ID NO: 809 - RNA, 19 nt, Artificial Sequence
  Synthetic siNA antisense region
cauggcuagacgcuuucug

SEQ ID NO: 810 - RNA, 19 nt, Artificial Sequence
  Synthetic siNA antisense region
ugguuuuucuuugagguuu

SEQ ID NO: 811 - RNA, 19 nt, Artificial Sequence
  Synthetic siNA antisense region
auggcuagacgcuuucugc

SEQ ID NO: 812 - RNA, 19 nt, Artificial Sequence
  Synthetic siNA antisense region
ccauggcuagacgcuuucu

SEQ ID NO: 813 - RNA, 19 nt, Artificial Sequence
  Synthetic siNA antisense region
ggcuagacgcuuucugcgu

SEQ ID NO: 814 - RNA, 19 nt, Artificial Sequence
  Synthetic siNA antisense region
uugguuuuucuuugagguu

SEQ ID NO: 815 - RNA, 19 nt, Artificial Sequence
  Synthetic siNA antisense region
guaucgaugaccuuaccca

SEQ ID NO: 816 - RNA, 19 nt, Artificial Sequence
  Synthetic siNA antisense region
aggguaucgaugaccuuac

SEQ ID NO: 817 - RNA, 19 nt, Artificial Sequence
  Synthetic siNA antisense region
uagacgcuuucugcgugaa

SEQ ID NO: 818 - RNA, 19 nt, Artificial Sequence
  Synthetic siNA antisense region
ggguaucgaugaccuuacc

SEQ ID NO: 819 - RNA, 19 nt, Artificial Sequence
  Synthetic siNA antisense region
uuccucacaggggagugau

SEQ ID NO: 820 - RNA, 19 nt, Artificial Sequence
  Synthetic siNA antisense region
guuccucacaggggaguga

SEQ ID NO: 821 - RNA, 19 nt, Artificial Sequence
  Synthetic siNA antisense region
cgcuuucugcgugaagaca

SEQ ID NO: 822 - RNA, 19 nt, Artificial Sequence
  Synthetic siNA antisense region
cuagacgcuuucugcguga

SEQ ID NO: 823 - RNA, 19 nt, Artificial Sequence
  Synthetic siNA antisense region
gcuagacgcuuucugcgug

SEQ ID NO: 824 - RNA, 19 nt, Artificial Sequence
  Synthetic siNA antisense region
uccaagaaaggacccgguc

SEQ ID NO: 825 - RNA, 19 nt, Artificial Sequence
  Synthetic siNA antisense region
gugaagacaguaguuccuc

SEQ ID NO: 826 - RNA, 19 nt, Artificial Sequence
  Synthetic siNA antisense region
agacaguaguuccucacag

SEQ ID NO: 827 - RNA, 19 nt, Artificial Sequence
  Synthetic siNA antisense region
gcgugaagacaguaguucc

SEQ ID NO: 828 - RNA, 19 nt, Artificial Sequence
  Synthetic siNA antisense region
uaguuccucacaggggagu

SEQ ID NO: 829 - RNA, 19 nt, Artificial Sequence
  Synthetic siNA antisense region
acgcuuucugcgugaagac

SEQ ID NO: 830 - RNA, 19 nt, Artificial Sequence
  Synthetic siNA antisense region
cgugaagacaguaguuccu

SEQ ID NO: 831 - RNA, 19 nt, Artificial Sequence
  Synthetic siNA antisense region
gacaguaguuccucacagg

SEQ ID NO: 832 - RNA, 19 nt, Artificial Sequence
  Synthetic siNA antisense region
aagacaguaguuccucaca

SEQ ID NO: 833 - RNA, 19 nt, Artificial Sequence
  Synthetic siNA antisense region
gacgcuuucugcgugaaga

SEQ ID NO: 834 - RNA, 19 nt, Artificial Sequence
  Synthetic siNA antisense region
ugcgugaagacaguaguuc

SEQ ID NO: 835 - RNA, 19 nt, Artificial Sequence
  Synthetic siNA antisense region
acaguaguuccucacaggg

SEQ ID NO: 836 - RNA, 19 nt, Artificial Sequence
  Synthetic siNA antisense region
agacgcuuucugcgugaag

SEQ ID NO: 837 - RNA, 19 nt, Artificial Sequence
  Synthetic siNA antisense region
ugaagacaguaguuccuca

SEQ ID NO: 838 - RNA, 19 nt, Artificial Sequence
  Synthetic siNA antisense region
gacacucauacuaacgcca

SEQ ID NO: 839 - RNA, 19 nt, Artificial Sequence
  Synthetic siNA antisense region
caguaguuccucacagggg

SEQ ID NO: 840 - RNA, 19 nt, Artificial Sequence
  Synthetic siNA antisense region
gaagacaguaguuccucac

SEQ ID NO: 841 - RNA, 19 nt, Artificial Sequence
  Synthetic siNA antisense region
cgacacucauacuaacgcc

SEQ ID NO: 842 - RNA, 19 nt, Artificial Sequence
  Synthetic siNA antisense region
cgacccaacacuacucggc

SEQ ID NO: 843 - RNA, 19 nt, Artificial Sequence
  Synthetic siNA antisense region
cuuucugcgugaagacagu

SEQ ID NO: 844 - RNA, 19 nt, Artificial Sequence
  Synthetic siNA antisense region
caaggccuuucgcgaccca

SEQ ID NO: 845 - RNA, 19 nt, Artificial Sequence
  Synthetic siNA antisense region
uucugcgugaagacaguag

SEQ ID NO: 846 - RNA, 19 nt, Artificial Sequence
  Synthetic siNA antisense region
cgcgacccaacacuacucg

SEQ ID NO: 847 - RNA, 19 nt, Artificial Sequence
  Synthetic siNA antisense region
uuucgcgacccaacacuac

SEQ ID NO: 848 - RNA, 19 nt, Artificial Sequence
  Synthetic siNA antisense region
gguuuuucuuugagguuua

SEQ ID NO: 849 - RNA, 19 nt, Artificial Sequence
  Synthetic siNA antisense region
gcgacccaacacuacucgg

SEQ ID NO: 850 - RNA, 19 nt, Artificial Sequence
  Synthetic siNA antisense region
gacccaacacuacucggcu

SEQ ID NO: 851 - RNA, 19 nt, Artificial Sequence
  Synthetic siNA antisense region
ccacaaggccuuucgcgac

SEQ ID NO: 852 - RNA, 19 nt, Artificial Sequence
  Synthetic siNA antisense region
cuuucgcgacccaacacua

SEQ ID NO: 853 - RNA, 19 nt, Artificial Sequence
  Synthetic siNA antisense region
cccaacacuacucggcuag

SEQ ID NO: 854 - RNA, 19 nt, Artificial Sequence
  Synthetic siNA antisense region
ucgcgacccaacacuacuc

SEQ ID NO: 855 - RNA, 19 nt, Artificial Sequence
  Synthetic siNA antisense region
accacaaggccuuucgcga

SEQ ID NO: 856 - RNA, 19 nt, Artificial Sequence
  Synthetic siNA antisense region
acgacacucauacuaacgc

SEQ ID NO: 857 - RNA, 19 nt, Artificial Sequence
  Synthetic siNA antisense region
acccaacacuacucggcua

SEQ ID NO: 858 - RNA, 19 nt, Artificial Sequence
  Synthetic siNA antisense region
cugcgugaagacaguaguu

SEQ ID NO: 859 - RNA, 19 nt, Artificial Sequence
  Synthetic siNA antisense region
uaccacaaggccuuucgcg

SEQ ID NO: 860 - RNA, 19 nt, Artificial Sequence
  Synthetic siNA antisense region
ccuuucgcgacccaacacu

SEQ ID NO: 861 - RNA, 19 nt, Artificial Sequence
  Synthetic siNA antisense region
aggccuuucgcgacccaac

SEQ ID NO: 862 - RNA, 19 nt, Artificial Sequence
  Synthetic siNA antisense region
uucgcgacccaacacuacu

SEQ ID NO: 863 - RNA, 19 nt, Artificial Sequence
  Synthetic siNA antisense region
aaggccuuucgcgacccaa

SEQ ID NO: 864 - RNA, 19 nt, Artificial Sequence
  Synthetic siNA antisense region
aguaguuccucacagggga

SEQ ID NO: 865 - RNA, 19 nt, Artificial Sequence
  Synthetic siNA antisense region
uuucugcgugaagacagua

SEQ ID NO: 866 - RNA, 19 nt, Artificial Sequence
  Synthetic siNA antisense region
gccuuucgcgacccaacac

SEQ ID NO: 867 - RNA, 19 nt, Artificial Sequence
  Synthetic siNA antisense region
ucugcgugaagacaguagu

SEQ ID NO: 868 - RNA, 19 nt, Artificial Sequence
  Synthetic siNA antisense region
gcuuucugcgugaagacag

SEQ ID NO: 869 - RNA, 19 nt, Artificial Sequence
  Synthetic siNA antisense region
acaaggccuuucgcgaccc

SEQ ID NO: 870 - RNA, 19 nt, Artificial Sequence
  Synthetic siNA antisense region
uuuuucuuugagguuuagg

SEQ ID NO: 871 - RNA, 19 nt, Artificial Sequence
  Synthetic siNA antisense region
cacaaggccuuucgcgacc

SEQ ID NO: 872 - RNA, 19 nt, Artificial Sequence
  Synthetic siNA antisense region
guuuuucuuugagguuuag

SEQ ID NO: 873 - RNA, 19 nt, Artificial Sequence
  Synthetic siNA antisense region
ggccuuucgcgacccaaca

SEQ ID NO: 874 - RNA, 19 nt, Artificial Sequence
  Synthetic siNA antisense region
guaguuccucacaggggag

SEQ ID NO: 875 - RNA, 19 nt, Artificial Sequence
  Synthetic siNA antisense region
uuuucuuugagguuuagga

SEQ ID NO: 876 - RNA, 19 nt, Artificial Sequence
  Synthetic siNA antisense region
auccaagaaaggacccggu

SEQ ID NO: 877 - RNA, 19 nt, Artificial Sequence
  Synthetic siNA antisense region
uucuuugagguuuaggauu

SEQ ID NO: 878 - RNA, 19 nt, Artificial Sequence
  Synthetic siNA antisense region
ccaaaucuccaggcauuga

SEQ ID NO: 879 - RNA, 19 nt, Artificial Sequence
  Synthetic siNA antisense region
cgcccaaaucuccaggcau

SEQ ID NO: 880 - RNA, 19 nt, Artificial Sequence
  Synthetic siNA antisense region
gcccaaaucuccaggcauu

SEQ ID NO: 881 - RNA, 19 nt, Artificial Sequence
  Synthetic siNA antisense region
auguaccccaugaggucgg

SEQ ID NO: 882 - RNA, 19 nt, Artificial Sequence
  Synthetic siNA antisense region
aaaucuccaggcauugagc

SEQ ID NO: 883 - RNA, 19 nt, Artificial Sequence
  Synthetic siNA antisense region
caaaucuccaggcauugag

SEQ ID NO: 884 - RNA, 19 nt, Artificial Sequence
  Synthetic siNA antisense region
ccaacacuacucggcuagc

SEQ ID NO: 885 - RNA, 19 nt, Artificial Sequence
  Synthetic siNA antisense region
aaucuccaggcauugagcg

SEQ ID NO: 886 - RNA, 19 nt, Artificial Sequence
  Synthetic siNA antisense region
cccaaaucuccaggcauug

SEQ ID NO: 887 - RNA, 19 nt, Artificial Sequence
  Synthetic siNA antisense region
uguaccccaugaggucggc

SEQ ID NO: 888 - RNA, 19 nt, Artificial Sequence
  Synthetic siNA antisense region
uuucuuugagguuuaggau

SEQ ID NO: 889 - RNA, 19 nt, Artificial Sequence
  Synthetic siNA antisense region
cgggggcacgcccaaaucu

SEQ ID NO: 890 - RNA, 19 nt, Artificial Sequence
  Synthetic siNA antisense region
ucuccaggcauugagcggg

SEQ ID NO: 891 - RNA, 19 nt, Artificial Sequence
  Synthetic siNA antisense region
gggggcacgcccaaaucuc

SEQ ID NO: 892 - RNA, 19 nt, Artificial Sequence
  Synthetic siNA antisense region
ggggcacgcccaaaucucc

SEQ ID NO: 893 - RNA, 19 nt, Artificial Sequence
  Synthetic siNA antisense region
gcgggggcacgcccaaauc

SEQ ID NO: 894 - RNA, 19 nt, Artificial Sequence
  Synthetic siNA antisense region
aucuccaggcauugagcgg

SEQ ID NO: 895 - RNA, 19 nt, Artificial Sequence
  Synthetic siNA antisense region
cuggcaauuccgguguacu

SEQ ID NO: 896 - RNA, 19 nt, Artificial Sequence
  Synthetic siNA antisense region
uccuggcaauuccggugua

SEQ ID NO: 897 - RNA, 19 nt, Artificial Sequence
  Synthetic siNA antisense region
uggcaauuccgguguacuc

SEQ ID NO: 898 - RNA, 19 nt, Artificial Sequence
  Synthetic siNA antisense region
ccuggcaauuccgguguac

SEQ ID NO: 899 - RNA, 19 nt, Artificial Sequence
  Synthetic siNA antisense region
uggggccccugcgcggcaa

SEQ ID NO: 900 - RNA, 19 nt, Artificial Sequence
  Synthetic siNA antisense region
ggcacgcccaaaucuccag

SEQ ID NO: 901 - RNA, 19 nt, Artificial Sequence
  Synthetic siNA antisense region
ggggccccugcgcggcaac

SEQ ID NO: 902 - RNA, 19 nt, Artificial Sequence
  Synthetic siNA antisense region
cacgcccaaaucuccaggc

SEQ ID NO: 903 - RNA, 19 nt, Artificial Sequence
  Synthetic siNA antisense region
gggcacgcccaaaucucca

SEQ ID NO: 904 - RNA, 19 nt, Artificial Sequence
  Synthetic siNA antisense region
gcacgcccaaaucuccagg

SEQ ID NO: 905 - RNA, 19 nt, Artificial Sequence
  Synthetic siNA antisense region
caacacuacucggcuagca

SEQ ID NO: 906 - RNA, 19 nt, Artificial Sequence
  Synthetic siNA antisense region
acgcccaaaucuccaggca

SEQ ID NO: 907 - RNA, 19 nt, Artificial Sequence
  Synthetic siNA antisense region
aacacuacucggcuagcag

SEQ ID NO: 908 - RNA, 19 nt, Artificial Sequence
  Synthetic siNA antisense region
acacuacucggcuagcagu

SEQ ID NO: 909 - RNA, 19 nt, Artificial Sequence
  Synthetic siNA antisense region
cacuacucggcuagcaguc

SEQ ID NO: 910 - RNA, 19 nt, Artificial Sequence
  Synthetic siNA antisense region
acuacucggcuagcagucu

SEQ ID NO: 911 - RNA, 19 nt, Artificial Sequence
  Synthetic siNA antisense region
cuccaggcauugagcgggu

SEQ ID NO: 912 - RNA, 19 nt, Artificial Sequence
  Synthetic siNA antisense region
uccaggcauugagcggguu

SEQ ID NO: 913 - RNA, 19 nt, Artificial Sequence
  Synthetic siNA antisense region
cuggggccccugcgcggca

SEQ ID NO: 914 - RNA, 19 nt, Artificial Sequence
  Synthetic siNA antisense region
cacccaaccuggggccccu

SEQ ID NO: 915 - RNA, 19 nt, Artificial Sequence
  Synthetic siNA antisense region
cacacccaaccuggggccc

SEQ ID NO: 916 - RNA, 19 nt, Artificial Sequence
  Synthetic siNA antisense region
acccaaccuggggccccug

SEQ ID NO: 917 - RNA, 19 nt, Artificial Sequence
  Synthetic siNA antisense region
gcacacccaaccuggggcc

SEQ ID NO: 918 - RNA, 19 nt, Artificial Sequence
  Synthetic siNA antisense region
ccaaccuggggccccugcg

SEQ ID NO: 919 - RNA, 19 nt, Artificial Sequence
  Synthetic siNA antisense region
acaggagccauccugccca

SEQ ID NO: 920 - RNA, 19 nt, Artificial Sequence
  Synthetic siNA antisense region
cgcacacccaaccuggggc

SEQ ID NO: 921 - RNA, 19 nt, Artificial Sequence
  Synthetic siNA antisense region
cccaaccuggggccccugc

SEQ ID NO: 922 - RNA, 19 nt, Artificial Sequence
  Synthetic siNA antisense region
gacaggagccauccugccc

SEQ ID NO: 923 - RNA, 19 nt, Artificial Sequence
  Synthetic siNA antisense region
acacccaaccuggggcccc

SEQ ID NO: 924 - RNA, 19 nt, Artificial Sequence
  Synthetic siNA antisense region
ccuggggccccugcgcggc

SEQ ID NO: 925 - RNA, 19 nt, Artificial Sequence
  Synthetic siNA antisense region
caaccuggggccccugcgc

SEQ ID NO: 926 - RNA, 19 nt, Artificial Sequence
  Synthetic siNA antisense region
aaccuggggccccugcgcg

SEQ ID NO: 927 - RNA, 19 nt, Artificial Sequence
  Synthetic siNA antisense region
accuggggccccugcgcgg

SEQ ID NO: 928 - RNA, 19 nt, Artificial Sequence
  Synthetic siNA antisense region
gaaaggacccggucguccu

SEQ ID NO: 929 - RNA, 19 nt, Artificial Sequence
  Synthetic siNA antisense region
aaaggacccggucguccug

SEQ ID NO: 930 - RNA, 19 nt, Artificial Sequence
  Synthetic siNA antisense region
ggacccggucguccuggca

SEQ ID NO: 931 - RNA, 19 nt, Artificial Sequence
  Synthetic siNA antisense region
acccggucguccuggcaau

SEQ ID NO: 932 - RNA, 19 nt, Artificial Sequence
  Synthetic siNA antisense region
cccggucguccuggcaauu

SEQ ID NO: 933 - RNA, 19 nt, Artificial Sequence
  Synthetic siNA antisense region
gacccggucguccuggcaa

SEQ ID NO: 934 - RNA, 19 nt, Artificial Sequence
  Synthetic siNA antisense region
aaggacccggucguccugg

SEQ ID NO: 935 - RNA, 19 nt, Artificial Sequence
  Synthetic siNA antisense region
aggacccggucguccuggc

SEQ ID NO: 936 - RNA, 19 nt, Artificial Sequence
  Synthetic siNA antisense region
ccggucguccuggcaauuc

SEQ ID NO: 937 - RNA, 19 nt, Artificial Sequence
  Synthetic siNA antisense region
caagaaaggacccggucgu

SEQ ID NO: 938 - RNA, 19 nt, Artificial Sequence
  Synthetic siNA antisense region
aagaaaggacccggucguc

SEQ ID NO: 939 - RNA, 19 nt, Artificial Sequence
  Synthetic siNA antisense region
ccaagaaaggacccggucg

SEQ ID NO: 940 - RNA, 19 nt, Artificial Sequence
  Synthetic siNA antisense region
agaaaggacccggucgucc

SEQ ID NO: 941 - RNA, 19 nt, Artificial Sequence
  Synthetic siNA antisense region
gucguccuggcaauuccgg

SEQ ID NO: 942 - RNA, 19 nt, Artificial Sequence
  Synthetic siNA antisense region
guccuggcaauuccggugu

SEQ ID NO: 943 - RNA, 19 nt, Artificial Sequence
  Synthetic siNA antisense region
ucguccuggcaauuccggu

SEQ ID NO: 944 - RNA, 19 nt, Artificial Sequence
  Synthetic siNA antisense region
ggucguccuggcaauuccg

SEQ ID NO: 945 - RNA, 19 nt, Artificial Sequence
  Synthetic siNA antisense region
cggucguccuggcaauucc

SEQ ID NO: 946 - RNA, 19 nt, Artificial Sequence
  Synthetic siNA antisense region
cguccuggcaauuccggug

SEQ ID NO: 947 - RNA, 19 nt, Artificial Sequence
  Synthetic siNA antisense region
gcgcacacccaaccugggg

SEQ ID NO: 948 - RNA, 19 nt, Artificial Sequence
  Synthetic siNA antisense region
guaaacuccaccaacgauc

SEQ ID NO: 949 - RNA, 19 nt, Artificial Sequence
  Synthetic siNA antisense region
aaacuccaccaacgaucug

SEQ ID NO: 950 - RNA, 19 nt, Artificial Sequence
  Synthetic siNA antisense region
uaaacuccaccaacgaucu

SEQ ID NO: 951 - RNA, 19 nt, Artificial Sequence
  Synthetic siNA antisense region
cgcgcacacccaaccuggg

SEQ ID NO: 952 - RNA, 19 nt, Artificial Sequence
  Synthetic siNA antisense region
gcgcgcacacccaaccugg

SEQ ID NO: 953 - RNA, 19 nt, Artificial Sequence
  Synthetic siNA antisense region
ucgcgcgcacacccaaccu

SEQ ID NO: 954 - RNA, 19 nt, Artificial Sequence
  Synthetic siNA antisense region
cgcgcgcacacccaaccug

SEQ ID NO: 955 - RNA, 19 nt, Artificial Sequence
  Synthetic siNA antisense region
gucgcgcgcacacccaacc

SEQ ID NO: 956 - RNA, 19 nt, Artificial Sequence
  Synthetic siNA antisense region
guguuacguuugguuuuuc

SEQ ID NO: 957 - RNA, 19 nt, Artificial Sequence
  Synthetic siNA antisense region
uguuacguuugguuuuucu

SEQ ID NO: 958 - RNA, 19 nt, Artificial Sequence
  Synthetic siNA antisense region
guugguguuacguuugguu

SEQ ID NO: 959 - RNA, 19 nt, Artificial Sequence
  Synthetic siNA antisense region
uuacguuugguuuuucuuu

SEQ ID NO: 960 - RNA, 19 nt, Artificial Sequence
  Synthetic siNA antisense region
gguguuacguuugguuuuu

SEQ ID NO: 961 - RNA, 19 nt, Artificial Sequence
  Synthetic siNA antisense region
guuacguuugguuuuucuu

SEQ ID NO: 962 - RNA, 19 nt, Artificial Sequence
  Synthetic siNA antisense region
uacguuugguuuuucuuug

SEQ ID NO: 963 - RNA, 19 nt, Artificial Sequence
  Synthetic siNA antisense region
cgcgaccuacgccgggggu

SEQ ID NO: 964 - RNA, 19 nt, Artificial Sequence
  Synthetic siNA antisense region
gcgaccuacgccggggguc

SEQ ID NO: 965 - RNA, 19 nt, Artificial Sequence
  Synthetic siNA antisense region
cacgacacucauacuaacg

SEQ ID NO: 966 - RNA, 19 nt, Artificial Sequence
  Synthetic siNA antisense region
gcacgacacucauacuaac

SEQ ID NO: 967 - RNA, 19 nt, Artificial Sequence
  Synthetic siNA antisense region
ugcacgacacucauacuaa

SEQ ID NO: 968 - RNA, 19 nt, Artificial Sequence
  Synthetic siNA antisense region
cgguugguguuacguuugg

SEQ ID NO: 969 - RNA, 19 nt, Artificial Sequence
  Synthetic siNA antisense region
gguugguguuacguuuggu

SEQ ID NO: 970 - RNA, 19 nt, Artificial Sequence
  Synthetic siNA antisense region
cucgcgggggcacgcccaa

SEQ ID NO: 971 - RNA, 19 nt, Artificial Sequence
  Synthetic siNA antisense region
cgcgggggcacgcccaaau

SEQ ID NO: 972 - RNA, 19 nt, Artificial Sequence
  Synthetic siNA antisense region
ucgcgggggcacgcccaaa

SEQ ID NO: 973 - RNA, 19 nt, Artificial Sequence
  Synthetic siNA antisense region
uugguguuacguuugguuu

SEQ ID NO: 974 - RNA, 19 nt, Artificial Sequence
  Synthetic siNA antisense region
ucucgcgggggcacgccca

SEQ ID NO: 975 - RNA, 19 nt, Artificial Sequence
  Synthetic siNA antisense region
acuccaccaacgaucugac

SEQ ID NO: 976 - RNA, 19 nt, Artificial Sequence
  Synthetic siNA antisense region
ccuggaggcugcacgacac

SEQ ID NO: 977 - RNA, 19 nt, Artificial Sequence
  Synthetic siNA antisense region
cuccaccaacgaucugacc

SEQ ID NO: 978 - RNA, 19 nt, Artificial Sequence
  Synthetic siNA antisense region
cuggaggcugcacgacacu

SEQ ID NO: 979 - RNA, 19 nt, Artificial Sequence
  Synthetic siNA antisense region
uggaggcugcacgacacuc

SEQ ID NO: 980 - RNA, 19 nt, Artificial Sequence
  Synthetic siNA antisense region
cauggugcacggucuacga

SEQ ID NO: 981 - RNA, 19 nt, Artificial Sequence
  Synthetic siNA antisense region
gugcucauggugcacgguc

SEQ ID NO: 982 - RNA, 19 nt, Artificial Sequence
  Synthetic siNA antisense region
gcugcacgacacucauacu

SEQ ID NO: 983 - RNA, 19 nt, Artificial Sequence
  Synthetic siNA antisense region
cugcacgacacucauacua

SEQ ID NO: 984 - RNA, 19 nt, Artificial Sequence
  Synthetic siNA antisense region
aacuccaccaacgaucuga

SEQ ID NO: 985 - RNA, 19 nt, Artificial Sequence
  Synthetic siNA antisense region
ugcucauggugcacggucu

SEQ ID NO: 986 - RNA, 19 nt, Artificial Sequence
  Synthetic siNA antisense region
ugguguuacguuugguuuu

SEQ ID NO: 987 - RNA, 19 nt, Artificial Sequence
  Synthetic siNA antisense region
cucauggugcacggucuac

SEQ ID NO: 988 - RNA, 19 nt, Artificial Sequence
  Synthetic siNA antisense region
auggugcacggucuacgag

SEQ ID NO: 989 - RNA, 19 nt, Artificial Sequence
  Synthetic siNA antisense region
ucauggugcacggucuacg

SEQ ID NO: 990 - RNA, 19 nt, Artificial Sequence
  Synthetic siNA antisense region
uacccgggcugagcccagg

SEQ ID NO: 991 - RNA, 19 nt, Artificial Sequence
  Synthetic siNA antisense region
gcucauggugcacggucua

SEQ ID NO: 992 - RNA, 19 nt, Artificial Sequence
  Synthetic siNA antisense region
gugcacggucuacgagacc

SEQ ID NO: 993 - RNA, 19 nt, Artificial Sequence
  Synthetic siNA antisense region
uggugcacggucuacgaga

SEQ ID NO: 994 - RNA, 19 nt, Artificial Sequence
  Synthetic siNA antisense region
ggugcacggucuacgagac

SEQ ID NO: 995 - RNA, 19 nt, Artificial Sequence
  Synthetic siNA antisense region
uaucgaugaccuuacccaa

SEQ ID NO: 996 - RNA, 19 nt, Artificial Sequence
  Synthetic siNA antisense region
uaccccaugaggucggcga

SEQ ID NO: 997 - RNA, 19 nt, Artificial Sequence
  Synthetic siNA antisense region
guuugguuuuucuuugagg

SEQ ID NO: 998 - RNA, 19 nt, Artificial Sequence
  Synthetic siNA antisense region
gucucgcgggggcacgccc

SEQ ID NO: 999 - RNA, 19 nt, Artificial Sequence
  Synthetic siNA antisense region
gcuaucagccgguucaucc

SEQ ID NO: 1000 - RNA, 19 nt, Artificial Sequence
  Synthetic siNA antisense region
cuaucagccgguucaucca

SEQ ID NO: 1001 - RNA, 19 nt, Artificial Sequence
  Synthetic siNA antisense region
cguuugguuuuucuuugag

SEQ ID NO: 1002 - RNA, 19 nt, Artificial Sequence
  Synthetic siNA antisense region
accgcucggaagucuuccu

SEQ ID NO: 1003 - RNA, 19 nt, Artificial Sequence
  Synthetic siNA antisense region
acguuugguuuuucuuuga

SEQ ID NO: 1004 - RNA, 19 nt, Artificial Sequence
  Synthetic siNA antisense region
gaccgcucggaagucuucc

SEQ ID NO: 1005 - RNA, 19 nt, Artificial Sequence
  Synthetic siNA antisense region
guaccccaugaggucggcg

SEQ ID NO: 1006 - RNA, 19 nt, Artificial Sequence
  Synthetic siNA antisense region
gguugcgaccgcucggaag

SEQ ID NO: 1007 - RNA, 19 nt, Artificial Sequence
  Synthetic siNA antisense region
agucucgcgggggcacgcc

SEQ ID NO: 1008 - RNA, 19 nt, Artificial Sequence
  Synthetic siNA antisense region
aggcugcacgacacucaua

SEQ ID NO: 1009 - RNA, 19 nt, Artificial Sequence
  Synthetic siNA antisense region
uagcagucucgcgggggca

SEQ ID NO: 1010 - RNA, 19 nt, Artificial Sequence
  Synthetic siNA antisense region
uacucggcuagcagucucg

SEQ ID NO: 1011 - RNA, 19 nt, Artificial Sequence
  Synthetic siNA antisense region
ggaggcugcacgacacuca

SEQ ID NO: 1012 - RNA, 19 nt, Artificial Sequence
  Synthetic siNA antisense region
cuagcagucucgcgggggc

SEQ ID NO: 1013 - RNA, 19 nt, Artificial Sequence
  Synthetic siNA antisense region
cuacucggcuagcagucuc

SEQ ID NO: 1014 - RNA, 19 nt, Artificial Sequence
  Synthetic siNA antisense region
gcuagcagucucgcggggg

SEQ ID NO: 1015 - RNA, 19 nt, Artificial Sequence
  Synthetic siNA antisense region
cucggcuagcagucucgcg

SEQ ID NO: 1016 - RNA, 19 nt, Artificial Sequence
  Synthetic siNA antisense region
ggcugcacgacacucauac

SEQ ID NO: 1017 - RNA, 19 nt, Artificial Sequence
  Synthetic siNA antisense region
gaggcugcacgacacucau

SEQ ID NO: 1018 - RNA, 19 nt, Artificial Sequence
  Synthetic siNA antisense region
acucggcuagcagucucgc

SEQ ID NO: 1019 - RNA, 19 nt, Artificial Sequence
  Synthetic siNA antisense region
ggcuagcagucucgcgggg

SEQ ID NO: 1020 - RNA, 19 nt, Artificial Sequence
  Synthetic siNA antisense region
ucggcuagcagucucgcgg

SEQ ID NO: 1021 - RNA, 19 nt, Artificial Sequence
  Synthetic siNA antisense region
cggcuagcagucucgcggg

SEQ ID NO: 1022 - RNA, 19 nt, Artificial Sequence
  Synthetic siNA antisense region
cagucucgcgggggcacgc

SEQ ID NO: 1023 - RNA, 19 nt, Artificial Sequence
  Synthetic siNA antisense region
ucucccgggaggggggguc

SEQ ID NO: 1024 - RNA, 19 nt, Artificial Sequence
  Synthetic siNA antisense region
ugauccaagaaaggacccg

SEQ ID NO: 1025 - RNA, 19 nt, Artificial Sequence
  Synthetic siNA antisense region
agcagucucgcgggggcac

SEQ ID NO: 1026 - RNA, 19 nt, Artificial Sequence
  Synthetic siNA antisense region
gcagucucgcgggggcacg

SEQ ID NO: 1027 - RNA, 19 nt, Artificial Sequence
  Synthetic siNA antisense region
accccaugaggucggcgaa

SEQ ID NO: 1028 - RNA, 19 nt, Artificial Sequence
  Synthetic siNA antisense region
acuugacguccugugggcg

SEQ ID NO: 1029 - RNA, 19 nt, Artificial Sequence
  Synthetic siNA antisense region
aacuugacguccugugggc

SEQ ID NO: 1030 - RNA, 19 nt, Artificial Sequence
  Synthetic siNA antisense region
cucucccgggagggggggu

SEQ ID NO: 1031 - RNA, 19 nt, Artificial Sequence
  Synthetic siNA antisense region
cucccgggagggggggucc

SEQ ID NO: 1032 - RNA, 19 nt, Artificial Sequence
  Synthetic siNA antisense region
gauccaagaaaggacccgg

SEQ ID NO: 1033 - RNA, 19 nt, Artificial Sequence
  Synthetic siNA antisense region
cccgggaggggggguccug

SEQ ID NO: 1034 - RNA, 19 nt, Artificial Sequence
  Synthetic siNA antisense region
cccgggaacuugacguccu

SEQ ID NO: 1035 - RNA, 19 nt, Artificial Sequence
  Synthetic siNA antisense region
ucccgggaggggggguccu

SEQ ID NO: 1036 - RNA, 19 nt, Artificial Sequence
  Synthetic siNA antisense region
ggaacuugacguccugugg

SEQ ID NO: 1037 - RNA, 19 nt, Artificial Sequence
  Synthetic siNA antisense region
ccgggaacuugacguccug

SEQ ID NO: 1038 - RNA, 19 nt, Artificial Sequence
  Synthetic siNA antisense region
cgggaacuugacguccugu

SEQ ID NO: 1039 - RNA, 19 nt, Artificial Sequence
  Synthetic siNA antisense region
gggaacuugacguccugug

SEQ ID NO: 1040 - RNA, 19 nt, Artificial Sequence
  Synthetic siNA antisense region
ucagccgguucauccacug

SEQ ID NO: 1041 - RNA, 19 nt, Artificial Sequence
  Synthetic siNA antisense region
ggguacccgggcugagccc

SEQ ID NO: 1042 - RNA, 19 nt, Artificial Sequence
  Synthetic siNA antisense region
cgagguugcgaccgcucgg

SEQ ID NO: 1043 - RNA, 19 nt, Artificial Sequence
  Synthetic siNA antisense region
guacccgggcugagcccag

SEQ ID NO: 1044 - RNA, 19 nt, Artificial Sequence
  Synthetic siNA antisense region
aucagccgguucauccacu

SEQ ID NO: 1045 - RNA, 19 nt, Artificial Sequence
  Synthetic siNA antisense region
gagguugcgaccgcucgga

SEQ ID NO: 1046 - RNA, 19 nt, Artificial Sequence
  Synthetic siNA antisense region
gguacccgggcugagccca

SEQ ID NO: 1047 - RNA, 19 nt, Artificial Sequence
  Synthetic siNA antisense region
uagaggggccaaggguacc

SEQ ID NO: 1048 - RNA, 19 nt, Artificial Sequence
  Synthetic siNA antisense region
agguugcgaccgcucggaa

SEQ ID NO: 1049 - RNA, 19 nt, Artificial Sequence
  Synthetic siNA antisense region
agaggggccaaggguaccc

SEQ ID NO: 1050 - RNA, 19 nt, Artificial Sequence
  Synthetic siNA antisense region
uugauccaagaaaggaccc

SEQ ID NO: 1051 - RNA, 19 nt, Artificial Sequence
  Synthetic siNA antisense region
gaacuugacguccuguggg

SEQ ID NO: 1052 - RNA, 19 nt, Artificial Sequence
  Synthetic siNA antisense region
agauagagaaagagcaacc

SEQ ID NO: 1053 - RNA, 19 nt, Artificial Sequence
  Synthetic siNA antisense region
caggagccauccugcccac

SEQ ID NO: 1054 - RNA, 19 nt, Artificial Sequence
  Synthetic siNA antisense region
aggagccauccugcccacc

SEQ ID NO: 1055 - RNA, 19 nt, Artificial Sequence
  Synthetic siNA antisense region
aagauagagaaagagcaac

SEQ ID NO: 1056 - RNA, 19 nt, Artificial Sequence
  Synthetic siNA antisense region
uaucagccgguucauccac

SEQ ID NO: 1057 - RNA, 19 nt, Artificial Sequence
  Synthetic siNA antisense region
ccgggaggggggguccugg

SEQ ID NO: 1058 - RNA, 19 nt, Artificial Sequence
  Synthetic siNA antisense region
ggagccauccugcccaccc

SEQ ID NO: 1059 - RNA, 19 nt, Artificial Sequence
  Synthetic siNA antisense region
agucauagccuccgugaag

SEQ ID NO: 1060 - RNA, 19 nt, Artificial Sequence
  Synthetic siNA antisense region
acguccugugggcggcggu

SEQ ID NO: 1061 - RNA, 19 nt, Artificial Sequence
  Synthetic siNA antisense region
cgggaggggggguccugga

SEQ ID NO: 1062 - RNA, 19 nt, Artificial Sequence
  Synthetic siNA antisense region
gaccaguucaucaucauau

SEQ ID NO: 1063 - RNA, 19 nt, Artificial Sequence
  Synthetic siNA antisense region
uagucauagccuccgugaa

SEQ ID NO: 1064 - RNA, 19 nt, Artificial Sequence
  Synthetic siNA antisense region
cuagucauagccuccguga

SEQ ID NO: 1065 - RNA, 19 nt, Artificial Sequence
  Synthetic siNA antisense region
acgcuaucagccgguucau

SEQ ID NO: 1066 - RNA, 19 nt, Artificial Sequence
  Synthetic siNA antisense region
caguucaucaucauauccc

SEQ ID NO: 1067 - RNA, 19 nt, Artificial Sequence
  Synthetic siNA antisense region
agccgguucauccacugca

SEQ ID NO: 1068 - RNA, 19 nt, Artificial Sequence
  Synthetic siNA antisense region
gccgguucauccacugcac

SEQ ID NO: 1069 - RNA, 19 nt, Artificial Sequence
  Synthetic siNA antisense region
aacgcuaucagccgguuca

SEQ ID NO: 1070 - RNA, 19 nt, Artificial Sequence
  Synthetic siNA antisense region
ccaguucaucaucauaucc

SEQ ID NO: 1071 - RNA, 19 nt, Artificial Sequence
  Synthetic siNA antisense region
aggaagauagagaaagagc

SEQ ID NO: 1072 - RNA, 19 nt, Artificial Sequence
  Synthetic siNA antisense region
augguggagugucgccccc

SEQ ID NO: 1073 - RNA, 19 nt, Artificial Sequence
  Synthetic siNA antisense region
cgcuaucagccgguucauc

SEQ ID NO: 1074 - RNA, 19 nt, Artificial Sequence
  Synthetic siNA antisense region
accaguucaucaucauauc

SEQ ID NO: 1075 - RNA, 19 nt, Artificial Sequence
  Synthetic siNA antisense region
aguucaucaucauauccca

SEQ ID NO: 1076 - RNA, 19 nt, Artificial Sequence
  Synthetic siNA antisense region
gaagauagagaaagagcaa

SEQ ID NO: 1077 - RNA, 19 nt, Artificial Sequence
  Synthetic siNA antisense region
ugguggagugucgccccca

SEQ ID NO: 1078 - RNA, 19 nt, Artificial Sequence
  Synthetic siNA antisense region
ggaagauagagaaagagca

SEQ ID NO: 1079 - RNA, 19 nt, Artificial Sequence
  Synthetic siNA antisense region
guugauccaagaaaggacc

SEQ ID NO: 1080 - RNA, 19 nt, Artificial Sequence
  Synthetic siNA antisense region
gcgaccgcucggaagucuu

SEQ ID NO: 1081 - RNA, 19 nt, Artificial Sequence
  Synthetic siNA antisense region
ggccaaggguacccgggcu

SEQ ID NO: 1082 - RNA, 19 nt, Artificial Sequence
  Synthetic siNA antisense region
agcggguugauccaagaaa

SEQ ID NO: 1083 - RNA, 19 nt, Artificial Sequence
  Synthetic siNA antisense region
gccaaggguacccgggcug

SEQ ID NO: 1084 - RNA, 19 nt, Artificial Sequence
  Synthetic siNA antisense region
ugcgaccgcucggaagucu

SEQ ID NO: 1085 - RNA, 19 nt, Artificial Sequence
  Synthetic siNA antisense region
gagcggguugauccaagaa

SEQ ID NO: 1086 - RNA, 19 nt, Artificial Sequence
  Synthetic siNA antisense region
ggggccaaggguacccggg

SEQ ID NO: 1087 - RNA, 19 nt, Artificial Sequence
  Synthetic siNA antisense region
gguugauccaagaaaggac

SEQ ID NO: 1088 - RNA, 19 nt, Artificial Sequence
  Synthetic siNA antisense region
gcggguugauccaagaaag

SEQ ID NO: 1089 - RNA, 19 nt, Artificial Sequence
  Synthetic siNA antisense region
cggguugauccaagaaagg

SEQ ID NO: 1090 - RNA, 19 nt, Artificial Sequence
  Synthetic siNA antisense region
ggguugauccaagaaagga

SEQ ID NO: 1091 - RNA, 19 nt, Artificial Sequence
  Synthetic siNA antisense region
gaccaccgcccgggaacuu

SEQ ID NO: 1092 - RNA, 19 nt, Artificial Sequence
  Synthetic siNA antisense region
cagccgguucauccacugc

SEQ ID NO: 1093 - RNA, 19 nt, Artificial Sequence
  Synthetic siNA antisense region
aggggccaaggguacccgg

SEQ ID NO: 1094 - RNA, 19 nt, Artificial Sequence
  Synthetic siNA antisense region
ugaccaccgcccgggaacu

SEQ ID NO: 1095 - RNA, 19 nt, Artificial Sequence
  Synthetic siNA antisense region
uugagcggguugauccaag

SEQ ID NO: 1096 - RNA, 19 nt, Artificial Sequence
  Synthetic siNA antisense region
gcauugagcggguugaucc

SEQ ID NO: 1097 - RNA, 19 nt, Artificial Sequence
  Synthetic siNA antisense region
guugcgaccgcucggaagu

SEQ ID NO: 1098 - RNA, 19 nt, Artificial Sequence
  Synthetic siNA antisense region
ugagcggguugauccaaga

SEQ ID NO: 1099 - RNA, 19 nt, Artificial Sequence
  Synthetic siNA antisense region
auugagcggguugauccaa

SEQ ID NO: 1100 - RNA, 19 nt, Artificial Sequence
  Synthetic siNA antisense region
cguccugugggcggcgguu

SEQ ID NO: 1101 - RNA, 19 nt, Artificial Sequence
  Synthetic siNA antisense region
ccuguugcauaguucacgc

SEQ ID NO: 1102 - RNA, 19 nt, Artificial Sequence
  Synthetic siNA antisense region
aggcauugagcggguugau

SEQ ID NO: 1103 - RNA, 19 nt, Artificial Sequence
  Synthetic siNA antisense region
ggcauugagcggguugauc

SEQ ID NO: 1104 - RNA, 19 nt, Artificial Sequence
  Synthetic siNA antisense region
ccaggcauugagcggguug

SEQ ID NO: 1105 - RNA, 19 nt, Artificial Sequence
  Synthetic siNA antisense region
cccaugaggucggcgaagc

SEQ ID NO: 1106 - RNA, 19 nt, Artificial Sequence
  Synthetic siNA antisense region
uugcgaccgcucggaaguc

SEQ ID NO: 1107 - RNA, 19 nt, Artificial Sequence
  Synthetic siNA antisense region
caggcauugagcggguuga

SEQ ID NO: 1108 - RNA, 19 nt, Artificial Sequence
  Synthetic siNA antisense region
ccaugaggucggcgaagcc

SEQ ID NO: 1109 - RNA, 19 nt, Artificial Sequence
  Synthetic siNA antisense region
cauugagcggguugaucca

SEQ ID NO: 1110 - RNA, 19 nt, Artificial Sequence
  Synthetic siNA antisense region
acgaucugaccaccgcccg

SEQ ID NO: 1111 - RNA, 19 nt, Artificial Sequence
  Synthetic siNA antisense region
uugccauagaggggccaag

SEQ ID NO: 1112 - RNA, 19 nt, Artificial Sequence
  Synthetic siNA antisense region
cgaucugaccaccgcccgg

SEQ ID NO: 1113 - RNA, 19 nt, Artificial Sequence
  Synthetic siNA antisense region
agccauccugcccacccca

SEQ ID NO: 1114 - RNA, 19 nt, Artificial Sequence
  Synthetic siNA antisense region
gcggcaacagguaaacucc

SEQ ID NO: 1115 - RNA, 19 nt, Artificial Sequence
  Synthetic siNA antisense region
ugccauagaggggccaagg

SEQ ID NO: 1116 - RNA, 19 nt, Artificial Sequence
  Synthetic siNA antisense region
ggcaacagguaaacuccac

SEQ ID NO: 1117 - RNA, 19 nt, Artificial Sequence
  Synthetic siNA antisense region
gcaacagguaaacuccacc

SEQ ID NO: 1118 - RNA, 19 nt, Artificial Sequence
  Synthetic siNA antisense region
ucugaccaccgcccgggaa

SEQ ID NO: 1119 - RNA, 19 nt, Artificial Sequence
  Synthetic siNA antisense region
uucccuguugcauaguuca

SEQ ID NO: 1120 - RNA, 19 nt, Artificial Sequence
  Synthetic siNA antisense region
gcgcggcaacagguaaacu

SEQ ID NO: 1121 - RNA, 19 nt, Artificial Sequence
  Synthetic siNA antisense region
ucccuguugcauaguucac

SEQ ID NO: 1122 - RNA, 19 nt, Artificial Sequence
  Synthetic siNA antisense region
ccugcgcggcaacagguaa

SEQ ID NO: 1123 - RNA, 19 nt, Artificial Sequence
  Synthetic siNA antisense region
aucugaccaccgcccggga

SEQ ID NO: 1124 - RNA, 19 nt, Artificial Sequence
  Synthetic siNA antisense region
cugaccaccgcccgggaac

SEQ ID NO: 1125 - RNA, 19 nt, Artificial Sequence
  Synthetic siNA antisense region
gggccaaggguacccgggc

SEQ ID NO: 1126 - RNA, 19 nt, Artificial Sequence
  Synthetic siNA antisense region
ccuucgccuucaucuccuu

SEQ ID NO: 1127 - RNA, 19 nt, Artificial Sequence
  Synthetic siNA antisense region
gccuucgccuucaucuccu

SEQ ID NO: 1128 - RNA, 19 nt, Artificial Sequence
  Synthetic siNA antisense region
ugcgcggcaacagguaaac

SEQ ID NO: 1129 - RNA, 19 nt, Artificial Sequence
  Synthetic siNA antisense region
ggccccugcgcggcaacag

SEQ ID NO: 1130 - RNA, 19 nt, Artificial Sequence
  Synthetic siNA antisense region
gugggcggcgguugguguu

SEQ ID NO: 1131 - RNA, 19 nt, Artificial Sequence
  Synthetic siNA antisense region
cgcggcaacagguaaacuc

SEQ ID NO: 1132 - RNA, 19 nt, Artificial Sequence
  Synthetic siNA antisense region
cugcgcggcaacagguaaa

SEQ ID NO: 1133 - RNA, 19 nt, Artificial Sequence
  Synthetic siNA antisense region
gagccauccugcccacccc

SEQ ID NO: 1134 - RNA, 19 nt, Artificial Sequence
  Synthetic siNA antisense region
cgaccgcucggaagucuuc

SEQ ID NO: 1135 - RNA, 19 nt, Artificial Sequence
  Synthetic siNA antisense region
ccccugcgcggcaacaggu

SEQ ID NO: 1136 - RNA, 19 nt, Artificial Sequence
  Synthetic siNA antisense region
cccugcgcggcaacaggua

SEQ ID NO: 1137 - RNA, 19 nt, Artificial Sequence
  Synthetic siNA antisense region
cugcccaguugaagaggua

SEQ ID NO: 1138 - RNA, 19 nt, Artificial Sequence
  Synthetic siNA antisense region
cccuguugcauaguucacg

SEQ ID NO: 1139 - RNA, 19 nt, Artificial Sequence
  Synthetic siNA antisense region
ugugggcggcgguuggugu

SEQ ID NO: 1140 - RNA, 19 nt, Artificial Sequence
  Synthetic siNA antisense region
gaucugaccaccgcccggg

SEQ ID NO: 1141 - RNA, 19 nt, Artificial Sequence
  Synthetic siNA antisense region
acugcccaguugaagaggu

SEQ ID NO: 1142 - RNA, 19 nt, Artificial Sequence
  Synthetic siNA antisense region
ccccaugaggucggcgaag

SEQ ID NO: 1143 - RNA, 19 nt, Artificial Sequence
  Synthetic siNA antisense region
gccccugcgcggcaacagg

SEQ ID NO: 1144 - RNA, 19 nt, Artificial Sequence
  Synthetic siNA antisense region
uccugugggcggcgguugg

SEQ ID NO: 1145 - RNA, 19 nt, Artificial Sequence
  Synthetic siNA antisense region
ccugugggcggcgguuggu

SEQ ID NO: 1146 - RNA, 19 nt, Artificial Sequence
  Synthetic siNA antisense region
cggcaacagguaaacucca

SEQ ID NO: 1147 - RNA, 19 nt, Artificial Sequence
  Synthetic siNA antisense region
cugugggcggcgguuggug

SEQ ID NO: 1148 - RNA, 19 nt, Artificial Sequence
  Synthetic siNA antisense region
gcgguugguguuacguuug

SEQ ID NO: 1149 - RNA, 19 nt, Artificial Sequence
  Synthetic siNA antisense region
cuccagccgucuccgcuug

SEQ ID NO: 1150 - RNA, 19 nt, Artificial Sequence
  Synthetic siNA antisense region
accuagucauagccuccgu

SEQ ID NO: 1151 - RNA, 19 nt, Artificial Sequence
  Synthetic siNA antisense region
ugggcggcgguugguguua

SEQ ID NO: 1152 - RNA, 19 nt, Artificial Sequence
  Synthetic siNA antisense region
gguaaacuccaccaacgau

SEQ ID NO: 1153 - RNA, 19 nt, Artificial Sequence
  Synthetic siNA antisense region
gcugugauauaugucuccc

SEQ ID NO: 1154 - RNA, 19 nt, Artificial Sequence
  Synthetic siNA antisense region
ugucgccuuccacgagguu

SEQ ID NO: 1155 - RNA, 19 nt, Artificial Sequence
  Synthetic siNA antisense region
ugugauauaugucuccccc

SEQ ID NO: 1156 - RNA, 19 nt, Artificial Sequence
  Synthetic siNA antisense region
cggcgguugguguuacguu

SEQ ID NO: 1157 - RNA, 19 nt, Artificial Sequence
  Synthetic siNA antisense region
ggcgguugguguuacguuu

SEQ ID NO: 1158 - RNA, 19 nt, Artificial Sequence
  Synthetic siNA antisense region
cugugauauaugucucccc

SEQ ID NO: 1159 - RNA, 19 nt, Artificial Sequence
  Synthetic siNA antisense region
acgccuucgccuucaucuc

SEQ ID NO: 1160 - RNA, 19 nt, Artificial Sequence
  Synthetic siNA antisense region
gcuccagccgucuccgcuu

SEQ ID NO: 1161 - RNA, 19 nt, Artificial Sequence
  Synthetic siNA antisense region
auagaggggccaaggguac

SEQ ID NO: 1162 - RNA, 19 nt, Artificial Sequence
  Synthetic siNA antisense region
ggaggggggguccuggagg

SEQ ID NO: 1163 - RNA, 19 nt, Artificial Sequence
  Synthetic siNA antisense region
gggaggggggguccuggag

SEQ ID NO: 1164 - RNA, 19 nt, Artificial Sequence
  Synthetic siNA antisense region
cauagaggggccaagggua

SEQ ID NO: 1165 - RNA, 19 nt, Artificial Sequence
  Synthetic siNA antisense region
gucgccuuccacgagguug

SEQ ID NO: 1166 - RNA, 19 nt, Artificial Sequence
  Synthetic siNA antisense region
uaccuagucauagccuccg

SEQ ID NO: 1167 - RNA, 19 nt, Artificial Sequence
  Synthetic siNA antisense region
cgccuucgccuucaucucc

SEQ ID NO: 1168 - RNA, 19 nt, Artificial Sequence
  Synthetic siNA antisense region
gacgccuucgccuucaucu

SEQ ID NO: 1169 - RNA, 19 nt, Artificial Sequence
  Synthetic siNA antisense region
gggcggcgguugguguuac

SEQ ID NO: 1170 - RNA, 19 nt, Artificial Sequence
  Synthetic siNA antisense region
ggcggcgguugguguuacg

SEQ ID NO: 1171 - RNA, 19 nt, Artificial Sequence
  Synthetic siNA antisense region
gcggcgguugguguuacgu

SEQ ID NO: 1172 - RNA, 19 nt, Artificial Sequence
  Synthetic siNA antisense region
ccuagucauagccuccgug

SEQ ID NO: 1173 - RNA, 19 nt, Artificial Sequence
  Synthetic siNA antisense region
acagguaaacuccaccaac

SEQ ID NO: 1174 - RNA, 19 nt, Artificial Sequence
  Synthetic siNA antisense region
cagguaaacuccaccaacg

SEQ ID NO: 1175 - RNA, 19 nt, Artificial Sequence
  Synthetic siNA antisense region
ccauagaggggccaagggu

SEQ ID NO: 1176 - RNA, 19 nt, Artificial Sequence
  Synthetic siNA antisense region
aacagguaaacuccaccaa

SEQ ID NO: 1177 - RNA, 19 nt, Artificial Sequence
  Synthetic siNA antisense region
caacagguaaacuccacca

SEQ ID NO: 1178 - RNA, 19 nt, Artificial Sequence
  Synthetic siNA antisense region
agguaaacuccaccaacga

SEQ ID NO: 1179 - RNA, 19 nt, Artificial Sequence
  Synthetic siNA antisense region
gaggggccaaggguacccg

SEQ ID NO: 1180 - RNA, 19 nt, Artificial Sequence
  Synthetic siNA antisense region
aggguacccgggcugagcc

SEQ ID NO: 1181 - RNA, 19 nt, Artificial Sequence
  Synthetic siNA antisense region
uccucacaggggagugauc

SEQ ID NO: 1182 - RNA, 19 nt, Artificial Sequence
  Synthetic siNA antisense region
caccaacgaucugaccacc

SEQ ID NO: 1183 - RNA, 19 nt, Artificial Sequence
  Synthetic siNA antisense region
ggacgccuucgccuucauc

SEQ ID NO: 1184 - RNA, 19 nt, Artificial Sequence
  Synthetic siNA antisense region
gggugacaggagccauccu

SEQ ID NO: 1185 - RNA, 19 nt, Artificial Sequence
  Synthetic siNA antisense region
caaggguacccgggcugag

SEQ ID NO: 1186 - RNA, 19 nt, Artificial Sequence
  Synthetic siNA antisense region
ccaaggguacccgggcuga

SEQ ID NO: 1187 - RNA, 19 nt, Artificial Sequence
  Synthetic siNA antisense region
uggacgccuucgccuucau

SEQ ID NO: 1188 - RNA, 19 nt, Artificial Sequence
  Synthetic siNA antisense region
gugauauaugucucccccg

SEQ ID NO: 1189 - RNA, 19 nt, Artificial Sequence
  Synthetic siNA antisense region
ggugacaggagccauccug

SEQ ID NO: 1190 - RNA, 19 nt, Artificial Sequence
  Synthetic siNA antisense region
guggacgccuucgccuuca

SEQ ID NO: 1191 - RNA, 19 nt, Artificial Sequence
  Synthetic siNA antisense region
uccaccaacgaucugacca

SEQ ID NO: 1192 - RNA, 19 nt, Artificial Sequence
  Synthetic siNA antisense region
aaggguacccgggcugagc

SEQ ID NO: 1193 - RNA, 19 nt, Artificial Sequence
  Synthetic siNA antisense region
ccaccaacgaucugaccac

SEQ ID NO: 1194 - RNA, 19 nt, Artificial Sequence
  Synthetic siNA antisense region
ggggggguccuggaggcug

SEQ ID NO: 1195 - RNA, 19 nt, Artificial Sequence
  Synthetic siNA antisense region
caacgaucugaccaccgcc

SEQ ID NO: 1196 - RNA, 19 nt, Artificial Sequence
  Synthetic siNA antisense region
gaggggggguccuggaggc

SEQ ID NO: 1197 - RNA, 19 nt, Artificial Sequence
  Synthetic siNA antisense region
cgaacgcuaucagccgguu

SEQ ID NO: 1198 - RNA, 19 nt, Artificial Sequence
  Synthetic siNA antisense region
aggggggguccuggaggcu

SEQ ID NO: 1199 - RNA, 19 nt, Artificial Sequence
  Synthetic siNA antisense region
caugaggucggcgaagccg

SEQ ID NO: 1200 - RNA, 19 nt, Artificial Sequence
  Synthetic siNA antisense region
gcgcuccagccgucuccgc

SEQ ID NO: 1201 - RNA, 19 nt, Artificial Sequence
  Synthetic siNA antisense region
agcggaauguaccccauga

SEQ ID NO: 1202 - RNA, 19 nt, Artificial Sequence
  Synthetic siNA antisense region
gaacgcuaucagccgguuc

SEQ ID NO: 1203 - RNA, 19 nt, Artificial Sequence
  Synthetic siNA antisense region
ccaacgaucugaccaccgc

SEQ ID NO: 1204 - RNA, 19 nt, Artificial Sequence
  Synthetic siNA antisense region
ugacaggagccauccugcc

SEQ ID NO: 1205 - RNA, 19 nt, Artificial Sequence
  Synthetic siNA antisense region
gugacaggagccauccugc

SEQ ID NO: 1206 - RNA, 19 nt, Artificial Sequence
  Synthetic siNA antisense region
ucgaugaccuuacccaaau

SEQ ID NO: 1207 - RNA, 19 nt, Artificial Sequence
  Synthetic siNA antisense region
gcgaacgcuaucagccggu

SEQ ID NO: 1208 - RNA, 19 nt, Artificial Sequence
  Synthetic siNA antisense region
cgcgcuccagccgucuccg

SEQ ID NO: 1209 - RNA, 19 nt, Artificial Sequence
  Synthetic siNA antisense region
augaggucggcgaagccgc

SEQ ID NO: 1210 - RNA, 19 nt, Artificial Sequence
  Synthetic siNA antisense region
cgaugaccuuacccaaauu

SEQ ID NO: 1211 - RNA, 19 nt, Artificial Sequence
  Synthetic siNA antisense region
aacgaucugaccaccgccc

SEQ ID NO: 1212 - RNA, 19 nt, Artificial Sequence
  Synthetic siNA antisense region
guccugugggcggcgguug

SEQ ID NO: 1213 - RNA, 19 nt, Artificial Sequence
  Synthetic siNA antisense region
ugaggucggcgaagccgca

SEQ ID NO: 1214 - RNA, 19 nt, Artificial Sequence
  Synthetic siNA antisense region
accaacgaucugaccaccg

SEQ ID NO: 1215 - RNA, 19 nt, Artificial Sequence
  Synthetic siNA antisense region
uagucgcgcgcacacccaa

SEQ ID NO: 1216 - RNA, 19 nt, Artificial Sequence
  Synthetic siNA antisense region
uuccuagucgcgcgcacac

SEQ ID NO: 1217 - RNA, 19 nt, Artificial Sequence
  Synthetic siNA antisense region
cggggugacaggagccauc

SEQ ID NO: 1218 - RNA, 19 nt, Artificial Sequence
  Synthetic siNA antisense region
ggggugacaggagccaucc

SEQ ID NO: 1219 - RNA, 19 nt, Artificial Sequence
  Synthetic siNA antisense region
cuuccuagucgcgcgcaca

SEQ ID NO: 1220 - RNA, 19 nt, Artificial Sequence
  Synthetic siNA antisense region
cuagucgcgcgcacaccca

SEQ ID NO: 1221 - RNA, 19 nt, Artificial Sequence
  Synthetic siNA antisense region
uccuagucgcgcgcacacc

SEQ ID NO: 1222 - RNA, 19 nt, Artificial Sequence
  Synthetic siNA antisense region
ccuagucgcgcgcacaccc

SEQ ID NO: 1223 - RNA, 19 nt, Artificial Sequence
  Synthetic siNA antisense region
uacgcgaccuacgccgggg

SEQ ID NO: 1224 - RNA, 19 nt, Artificial Sequence
  Synthetic siNA antisense region
gggauagguugucgccuuc

SEQ ID NO: 1225 - RNA, 19 nt, Artificial Sequence
  Synthetic siNA antisense region
uuacgcgaccuacgccggg

SEQ ID NO: 1226 - RNA, 19 nt, Artificial Sequence
  Synthetic siNA antisense region
cgcuccagccgucuccgcu

SEQ ID NO: 1227 - RNA, 19 nt, Artificial Sequence
  Synthetic siNA antisense region
acgcgaccuacgccggggg

SEQ ID NO: 1228 - RNA, 19 nt, Artificial Sequence
  Synthetic siNA antisense region
acuguggacgccuucgccu

SEQ ID NO: 1229 - RNA, 19 nt, Artificial Sequence
  Synthetic siNA antisense region
cuguggacgccuucgccuu

SEQ ID NO: 1230 - RNA, 19 nt, Artificial Sequence
  Synthetic siNA antisense region
agucgcgcgcacacccaac

SEQ ID NO: 1231 - RNA, 19 nt, Artificial Sequence
  Synthetic siNA antisense region
gcggaauguaccccaugag

SEQ ID NO: 1232 - RNA, 19 nt, Artificial Sequence
  Synthetic siNA antisense region
ggauagguugucgccuucc

SEQ ID NO: 1233 - RNA, 19 nt, Artificial Sequence
  Synthetic siNA antisense region
ccgucggcaaggaacuugc

SEQ ID NO: 1234 - RNA, 19 nt, Artificial Sequence
  Synthetic siNA antisense region
ggggguccuggaggcugca

SEQ ID NO: 1235 - RNA, 19 nt, Artificial Sequence
  Synthetic siNA antisense region
cacgagcaucgugcagucc

SEQ ID NO: 1236 - RNA, 19 nt, Artificial Sequence
  Synthetic siNA antisense region
uguggacgccuucgccuuc

SEQ ID NO: 1237 - RNA, 19 nt, Artificial Sequence
  Synthetic siNA antisense region
ucgccuuccacgagguugc

SEQ ID NO: 1238 - RNA, 19 nt, Artificial Sequence
  Synthetic siNA antisense region
accaagcacagcccgcguc

SEQ ID NO: 1239 - RNA, 19 nt, Artificial Sequence
  Synthetic siNA antisense region
uaccaagcacagcccgcgu

SEQ ID NO: 1240 - RNA, 19 nt, Artificial Sequence
  Synthetic siNA antisense region
gggguccuggaggcugcac

SEQ ID NO: 1241 - RNA, 19 nt, Artificial Sequence
  Synthetic siNA antisense region
gggggguccuggaggcugc

SEQ ID NO: 1242 - RNA, 19 nt, Artificial Sequence
  Synthetic siNA antisense region
cgccuuccacgagguugcg

SEQ ID NO: 1243 - RNA, 19 nt, Artificial Sequence
  Synthetic siNA antisense region
uccuggaggcugcacgaca

SEQ ID NO: 1244 - RNA, 19 nt, Artificial Sequence
  Synthetic siNA antisense region
ucaucauaucccaagccau

SEQ ID NO: 1245 - RNA, 19 nt, Artificial Sequence
  Synthetic siNA antisense region
uucaucaucauaucccaag

SEQ ID NO: 1246 - RNA, 19 nt, Artificial Sequence
  Synthetic siNA antisense region
gccauagaggggccaaggg

SEQ ID NO: 1247 - RNA, 19 nt, Artificial Sequence
  Synthetic siNA antisense region
aucaucauaucccaagcca

SEQ ID NO: 1248 - RNA, 19 nt, Artificial Sequence
  Synthetic siNA antisense region
cgguucauccacugcacag

SEQ ID NO: 1249 - RNA, 19 nt, Artificial Sequence
  Synthetic siNA antisense region
caagcacagcccgcgucau

SEQ ID NO: 1250 - RNA, 19 nt, Artificial Sequence
  Synthetic siNA antisense region
ucaucaucauaucccaagc

SEQ ID NO: 1251 - RNA, 19 nt, Artificial Sequence
  Synthetic siNA antisense region
aagcacagcccgcgucaua

SEQ ID NO: 1252 - RNA, 19 nt, Artificial Sequence
  Synthetic siNA antisense region
ccaagcacagcccgcguca

SEQ ID NO: 1253 - RNA, 19 nt, Artificial Sequence
  Synthetic siNA antisense region
caucaucauaucccaagcc

SEQ ID NO: 1254 - RNA, 19 nt, Artificial Sequence
  Synthetic siNA antisense region
ccgguucauccacugcaca

SEQ ID NO: 1255 - RNA, 19 nt, Artificial Sequence
  Synthetic siNA antisense region
gguucauccacugcacagc

SEQ ID NO: 1256 - RNA, 19 nt, Artificial Sequence
  Synthetic siNA antisense region
uuacugcccaguugaagag

SEQ ID NO: 1257 - RNA, 19 nt, Artificial Sequence
  Synthetic siNA antisense region
guugucgccuuccacgagg

SEQ ID NO: 1258 - RNA, 19 nt, Artificial Sequence
  Synthetic siNA antisense region
cgacugucugggugacaca

SEQ ID NO: 1259 - RNA, 19 nt, Artificial Sequence
  Synthetic siNA antisense region
cuguugcauaguucacgcc

SEQ ID NO: 1260 - RNA, 19 nt, Artificial Sequence
  Synthetic siNA antisense region
uguugcauaguucacgccg

SEQ ID NO: 1261 - RNA, 19 nt, Artificial Sequence
  Synthetic siNA antisense region
ucgacugucugggugacac

SEQ ID NO: 1262 - RNA, 19 nt, Artificial Sequence
  Synthetic siNA antisense region
uacugcccaguugaagagg

SEQ ID NO: 1263 - RNA, 19 nt, Artificial Sequence
  Synthetic siNA antisense region
uagguugucgccuuccacg

SEQ ID NO: 1264 - RNA, 19 nt, Artificial Sequence
  Synthetic siNA antisense region
agguugucgccuuccacga

SEQ ID NO: 1265 - RNA, 19 nt, Artificial Sequence
  Synthetic siNA antisense region
uggggccccaacuaggccg

SEQ ID NO: 1266 - RNA, 19 nt, Artificial Sequence
  Synthetic siNA antisense region
ucggaagucuuccuagucg

SEQ ID NO: 1267 - RNA, 19 nt, Artificial Sequence
  Synthetic siNA antisense region
aucgaugaccuuacccaaa

SEQ ID NO: 1268 - RNA, 19 nt, Artificial Sequence
  Synthetic siNA antisense region
auagguugucgccuuccac

SEQ ID NO: 1269 - RNA, 19 nt, Artificial Sequence
  Synthetic siNA antisense region
uugucgccuuccacgaggu

SEQ ID NO: 1270 - RNA, 19 nt, Artificial Sequence
  Synthetic siNA antisense region
cggaagucuuccuagucgc

SEQ ID NO: 1271 - RNA, 19 nt, Artificial Sequence
  Synthetic siNA antisense region
guccuggaggcugcacgac

SEQ ID NO: 1272 - RNA, 19 nt, Artificial Sequence
  Synthetic siNA antisense region
ccgcucggaagucuuccua

SEQ ID NO: 1273 - RNA, 19 nt, Artificial Sequence
  Synthetic siNA antisense region
guugcauaguucacgccgu

SEQ ID NO: 1274 - RNA, 19 nt, Artificial Sequence
  Synthetic siNA antisense region
gguugucgccuuccacgag

SEQ ID NO: 1275 - RNA, 19 nt, Artificial Sequence
  Synthetic siNA antisense region
cuuccacgagguugcgacc

SEQ ID NO: 1276 - RNA, 19 nt, Artificial Sequence
  Synthetic siNA antisense region
uuccacgagguugcgaccg

SEQ ID NO: 1277 - RNA, 19 nt, Artificial Sequence
  Synthetic siNA antisense region
agucuuccuagucgcgcgc

SEQ ID NO: 1278 - RNA, 19 nt, Artificial Sequence
  Synthetic siNA antisense region
uugcauaguucacgccguc

SEQ ID NO: 1279 - RNA, 19 nt, Artificial Sequence
  Synthetic siNA antisense region
cucacaggggagugaucua

SEQ ID NO: 1280 - RNA, 19 nt, Artificial Sequence
  Synthetic siNA antisense region
ccacgagguugcgaccgcu

SEQ ID NO: 1281 - RNA, 19 nt, Artificial Sequence
  Synthetic siNA antisense region
gauagguugucgccuucca

SEQ ID NO: 1282 - RNA, 19 nt, Artificial Sequence
  Synthetic siNA antisense region
aagucuuccuagucgcgcg

SEQ ID NO: 1283 - RNA, 19 nt, Artificial Sequence
  Synthetic siNA antisense region
cgcucggaagucuuccuag

SEQ ID NO: 1284 - RNA, 19 nt, Artificial Sequence
  Synthetic siNA antisense region
ucuuccuagucgcgcgcac

SEQ ID NO: 1285 - RNA, 19 nt, Artificial Sequence
  Synthetic siNA antisense region
ccucacaggggagugaucu

SEQ ID NO: 1286 - RNA, 19 nt, Artificial Sequence
  Synthetic siNA antisense region
gucuuccuagucgcgcgca

SEQ ID NO: 1287 - RNA, 19 nt, Artificial Sequence
  Synthetic siNA antisense region
ucacaggggagugaucuau

SEQ ID NO: 1288 - RNA, 19 nt, Artificial Sequence
  Synthetic siNA antisense region
cacgagguugcgaccgcuc

SEQ ID NO: 1289 - RNA, 19 nt, Artificial Sequence
  Synthetic siNA antisense region
guuggagcagucguucgug

SEQ ID NO: 1290 - RNA, 19 nt, Artificial Sequence
  Synthetic siNA antisense region
cgucggcaaggaacuugcc

SEQ ID NO: 1291 - RNA, 19 nt, Artificial Sequence
  Synthetic siNA antisense region
gguccuggaggcugcacga

SEQ ID NO: 1292 - RNA, 19 nt, Artificial Sequence
  Synthetic siNA antisense region
uggagcagucguucgugac

SEQ ID NO: 1293 - RNA, 19 nt, Artificial Sequence
  Synthetic siNA antisense region
uccacgagguugcgaccgc

SEQ ID NO: 1294 - RNA, 19 nt, Artificial Sequence
  Synthetic siNA antisense region
gaagucuuccuagucgcgc

SEQ ID NO: 1295 - RNA, 19 nt, Artificial Sequence
  Synthetic siNA antisense region
gcacagcccgcgucauagc

SEQ ID NO: 1296 - RNA, 19 nt, Artificial Sequence
  Synthetic siNA antisense region
uuggagcagucguucguga

SEQ ID NO: 1297 - RNA, 19 nt, Artificial Sequence
  Synthetic siNA antisense region
gccuuccacgagguugcga

SEQ ID NO: 1298 - RNA, 19 nt, Artificial Sequence
  Synthetic siNA antisense region
ggguccuggaggcugcacg

SEQ ID NO: 1299 - RNA, 19 nt, Artificial Sequence
  Synthetic siNA antisense region
ccuuccacgagguugcgac

SEQ ID NO: 1300 - RNA, 19 nt, Artificial Sequence
  Synthetic siNA antisense region
gcucggaagucuuccuagu

SEQ ID NO: 1301 - RNA, 19 nt, Artificial Sequence
  Synthetic siNA antisense region
ggaagucuuccuagucgcg

SEQ ID NO: 1302 - RNA, 19 nt, Artificial Sequence
  Synthetic siNA antisense region
uccacaugugcuucgccca

SEQ ID NO: 1303 - RNA, 19 nt, Artificial Sequence
  Synthetic siNA antisense region
cauggaauaguaggcaagg

SEQ ID NO: 1304 - RNA, 19 nt, Artificial Sequence
  Synthetic siNA antisense region
accccaaguuuccugaggc

SEQ ID NO: 1305 - RNA, 19 nt, Artificial Sequence
  Synthetic siNA antisense region
cacagcccgcgucauagca

SEQ ID NO: 1306 - RNA, 19 nt, Artificial Sequence
  Synthetic siNA antisense region
guagcgguggcgagcacga

SEQ ID NO: 1307 - RNA, 19 nt, Artificial Sequence
  Synthetic siNA antisense region
ccccaaguuuccugaggca

SEQ ID NO: 1308 - RNA, 19 nt, Artificial Sequence
  Synthetic siNA antisense region
cggggucgggcacgagaca

SEQ ID NO: 1309 - RNA, 19 nt, Artificial Sequence
  Synthetic siNA antisense region
cccaucuccugccgccaca

SEQ ID NO: 1310 - RNA, 19 nt, Artificial Sequence
  Synthetic siNA antisense region
uagcgguggcgagcacgac

SEQ ID NO: 1311 - RNA, 19 nt, Artificial Sequence
  Synthetic siNA antisense region
ccgucacguaguggaaauc

SEQ ID NO: 1312 - RNA, 19 nt, Artificial Sequence
  Synthetic siNA antisense region
ggaauaguaggcaaggccc

SEQ ID NO: 1313 - RNA, 19 nt, Artificial Sequence
  Synthetic siNA antisense region
auggaauaguaggcaaggc

SEQ ID NO: 1314 - RNA, 19 nt, Artificial Sequence
  Synthetic siNA antisense region
cucggaagucuuccuaguc

SEQ ID NO: 1315 - RNA, 19 nt, Artificial Sequence
  Synthetic siNA antisense region
ugauauaugucucccccgc

SEQ ID NO: 1316 - RNA, 19 nt, Artificial Sequence
  Synthetic siNA antisense region
acgagguugcgaccgcucg

SEQ ID NO: 1317 - RNA, 19 nt, Artificial Sequence
  Synthetic siNA antisense region
uggaauaguaggcaaggcc

SEQ ID NO: 1318 - RNA, 19 nt, Artificial Sequence
  Synthetic siNA antisense region
cccgucacguaguggaaau

SEQ ID NO: 1319 - RNA, 19 nt, Artificial Sequence
  Synthetic siNA antisense region
gcccgggaacuugacgucc

SEQ ID NO: 1320 - RNA, 19 nt, Artificial Sequence
  Synthetic siNA antisense region
agcccgcgucauagcacuc

SEQ ID NO: 1321 - RNA, 19 nt, Artificial Sequence
  Synthetic siNA antisense region
cgcccgggaacuugacguc

SEQ ID NO: 1322 - RNA, 19 nt, Artificial Sequence
  Synthetic siNA antisense region
gaccaagacccgucgcuga

SEQ ID NO: 1323 - RNA, 19 nt, Artificial Sequence
  Synthetic siNA antisense region
ccaccgcccgggaacuuga

SEQ ID NO: 1324 - RNA, 19 nt, Artificial Sequence
  Synthetic siNA antisense region
uucgccuucaucuccuuga

SEQ ID NO: 1325 - RNA, 19 nt, Artificial Sequence
  Synthetic siNA antisense region
ggcgagccuuggggauagg

SEQ ID NO: 1326 - RNA, 19 nt, Artificial Sequence
  Synthetic siNA antisense region
ugaucugagguaggucaag

SEQ ID NO: 1327 - RNA, 19 nt, Artificial Sequence
  Synthetic siNA antisense region
gcccgucacguaguggaaa

SEQ ID NO: 1328 - RNA, 19 nt, Artificial Sequence
  Synthetic siNA antisense region
cagcccgcgucauagcacu

SEQ ID NO: 1329 - RNA, 19 nt, Artificial Sequence
  Synthetic siNA antisense region
ccgcccgggaacuugacgu

SEQ ID NO: 1330 - RNA, 19 nt, Artificial Sequence
  Synthetic siNA antisense region
cuggcccgaugucuccaga

SEQ ID NO: 1331 - RNA, 19 nt, Artificial Sequence
  Synthetic siNA antisense region
uuccacaugugcuucgccc

SEQ ID NO: 1332 - RNA, 19 nt, Artificial Sequence
  Synthetic siNA antisense region
augaucugagguaggucaa

SEQ ID NO: 1333 - RNA, 19 nt, Artificial Sequence
  Synthetic siNA antisense region
uccagccgucuccgcuugg

SEQ ID NO: 1334 - RNA, 19 nt, Artificial Sequence
  Synthetic siNA antisense region
ccagccgucuccgcuuggu

SEQ ID NO: 1335 - RNA, 19 nt, Artificial Sequence
  Synthetic siNA antisense region
cugaggcaugaagccaccc

SEQ ID NO: 1336 - RNA, 19 nt, Artificial Sequence
  Synthetic siNA antisense region
caccgcccgggaacuugac

SEQ ID NO: 1337 - RNA, 19 nt, Artificial Sequence
  Synthetic siNA antisense region
ucgccuucaucuccuugag

SEQ ID NO: 1338 - RNA, 19 nt, Artificial Sequence
  Synthetic siNA antisense region
cagccgucuccgcuugguc

SEQ ID NO: 1339 - RNA, 19 nt, Artificial Sequence
  Synthetic siNA antisense region
ugguugagcccgaccugga

SEQ ID NO: 1340 - RNA, 19 nt, Artificial Sequence
  Synthetic siNA antisense region
gaggaagauagagaaagag

SEQ ID NO: 1341 - RNA, 19 nt, Artificial Sequence
  Synthetic siNA antisense region
uggcccgaugucuccagac

SEQ ID NO: 1342 - RNA, 19 nt, Artificial Sequence
  Synthetic siNA antisense region
ucgggggccaagucacaac

SEQ ID NO: 1343 - RNA, 19 nt, Artificial Sequence
  Synthetic siNA antisense region
uuggacuggagccaggucu

SEQ ID NO: 1344 - RNA, 19 nt, Artificial Sequence
  Synthetic siNA antisense region
ccauggaauaguaggcaag

SEQ ID NO: 1345 - RNA, 19 nt, Artificial Sequence
  Synthetic siNA antisense region
uagagaaagagcaaccggg

SEQ ID NO: 1346 - RNA, 19 nt, Artificial Sequence
  Synthetic siNA antisense region
aagaggaagauagagaaag

SEQ ID NO: 1347 - RNA, 19 nt, Artificial Sequence
  Synthetic siNA antisense region
ugaggcaugaagccacccu

SEQ ID NO: 1348 - RNA, 19 nt, Artificial Sequence
  Synthetic siNA antisense region
uggacuggagccaggucuu

SEQ ID NO: 1349 - RNA, 19 nt, Artificial Sequence
  Synthetic siNA antisense region
auagagaaagagcaaccgg

SEQ ID NO: 1350 - RNA, 19 nt, Artificial Sequence
  Synthetic siNA antisense region
gauagagaaagagcaaccg

SEQ ID NO: 1351 - RNA, 19 nt, Artificial Sequence
  Synthetic siNA antisense region
acguaguggaaauccccca

SEQ ID NO: 1352 - RNA, 19 nt, Artificial Sequence
  Synthetic siNA antisense region
gagcagucguucgugacau

SEQ ID NO: 1353 - RNA, 19 nt, Artificial Sequence
  Synthetic siNA antisense region
guggggccccaacuaggcc

SEQ ID NO: 1354 - RNA, 19 nt, Artificial Sequence
  Synthetic siNA antisense region
gccgucuccgcuuggucca

SEQ ID NO: 1355 - RNA, 19 nt, Artificial Sequence
  Synthetic siNA antisense region
gguugagcccgaccuggaa

SEQ ID NO: 1356 - RNA, 19 nt, Artificial Sequence
  Synthetic siNA antisense region
accaggaacucgacccgcu

SEQ ID NO: 1357 - RNA, 19 nt, Artificial Sequence
  Synthetic siNA antisense region
cuucgccuucaucuccuug

SEQ ID NO: 1358 - RNA, 19 nt, Artificial Sequence
  Synthetic siNA antisense region
agcagucguucgugacaug

SEQ ID NO: 1359 - RNA, 19 nt, Artificial Sequence
  Synthetic siNA antisense region
ccaggaacucgacccgcug

SEQ ID NO: 1360 - RNA, 19 nt, Artificial Sequence
  Synthetic siNA antisense region
ugcccgucacguaguggaa

SEQ ID NO: 1361 - RNA, 19 nt, Artificial Sequence
  Synthetic siNA antisense region
gaggcaugaagccacccua

SEQ ID NO: 1362 - RNA, 19 nt, Artificial Sequence
  Synthetic siNA antisense region
agcaucgugcaguccugga

SEQ ID NO: 1363 - RNA, 19 nt, Artificial Sequence
  Synthetic siNA antisense region
augcccgucacguagugga

SEQ ID NO: 1364 - RNA, 19 nt, Artificial Sequence
  Synthetic siNA antisense region
ggcaugaagccacccuauu

SEQ ID NO: 1365 - RNA, 19 nt, Artificial Sequence
  Synthetic siNA antisense region
ucauagccuccgugaagac

SEQ ID NO: 1366 - RNA, 19 nt, Artificial Sequence
  Synthetic siNA antisense region
aggcaugaagccacccuau

SEQ ID NO: 1367 - RNA, 19 nt, Artificial Sequence
  Synthetic siNA antisense region
gucauagccuccgugaaga

SEQ ID NO: 1368 - RNA, 19 nt, Artificial Sequence
  Synthetic siNA antisense region
cccaaguuuccugaggcau

SEQ ID NO: 1369 - RNA, 19 nt, Artificial Sequence
  Synthetic siNA antisense region
uccuugagcacgucccggu

SEQ ID NO: 1370 - RNA, 19 nt, Artificial Sequence
  Synthetic siNA antisense region
ucauccacugcacagcccc

SEQ ID NO: 1371 - RNA, 19 nt, Artificial Sequence
  Synthetic siNA antisense region
ucgugcaguccuggagcuu

SEQ ID NO: 1372 - RNA, 19 nt, Artificial Sequence
  Synthetic siNA antisense region
caucgugcaguccuggagc

SEQ ID NO: 1373 - RNA, 19 nt, Artificial Sequence
  Synthetic siNA antisense region
ccuugagcacgucccggua

SEQ ID NO: 1374 - RNA, 19 nt, Artificial Sequence
  Synthetic siNA antisense region
uucauccacugcacagccc

SEQ ID NO: 1375 - RNA, 19 nt, Artificial Sequence
  Synthetic siNA antisense region
accgcccgggaacuugacg

SEQ ID NO: 1376 - RNA, 19 nt, Artificial Sequence
  Synthetic siNA antisense region
caugaagccacccuauuga

SEQ ID NO: 1377 - RNA, 19 nt, Artificial Sequence
  Synthetic siNA antisense region
cauagccuccgugaagacu

SEQ ID NO: 1378 - RNA, 19 nt, Artificial Sequence
  Synthetic siNA antisense region
agccgucuccgcuuggucc

SEQ ID NO: 1379 - RNA, 19 nt, Artificial Sequence
  Synthetic siNA antisense region
aggagcuuggacuggagcc

SEQ ID NO: 1380 - RNA, 19 nt, Artificial Sequence
  Synthetic siNA antisense region
guucauccacugcacagcc

SEQ ID NO: 1381 - RNA, 19 nt, Artificial Sequence
  Synthetic siNA antisense region
gcaucgugcaguccuggag

SEQ ID NO: 1382 - RNA, 19 nt, Artificial Sequence
  Synthetic siNA antisense region
auagccuccgugaagacuc

SEQ ID NO: 1383 - RNA, 19 nt, Artificial Sequence
  Synthetic siNA antisense region
ggagcuuggacuggagcca

SEQ ID NO: 1384 - RNA, 19 nt, Artificial Sequence
  Synthetic siNA antisense region
ucacguaguggaaaucccc

SEQ ID NO: 1385 - RNA, 19 nt, Artificial Sequence
  Synthetic siNA antisense region
ccaaguuuccugaggcaug

SEQ ID NO: 1386 - RNA, 19 nt, Artificial Sequence
  Synthetic siNA antisense region
augaagccacccuauugau

SEQ ID NO: 1387 - RNA, 19 nt, Artificial Sequence
  Synthetic siNA antisense region
aauaguaggcaaggcccgc

SEQ ID NO: 1388 - RNA, 19 nt, Artificial Sequence
  Synthetic siNA antisense region
cuccuugagcacgucccgg

SEQ ID NO: 1389 - RNA, 19 nt, Artificial Sequence
  Synthetic siNA antisense region
gcccaguuccccaccaugg

SEQ ID NO: 1390 - RNA, 19 nt, Artificial Sequence
  Synthetic siNA antisense region
gcaugaagccacccuauug

SEQ ID NO: 1391 - RNA, 19 nt, Artificial Sequence
  Synthetic siNA antisense region
aucgugcaguccuggagcu

SEQ ID NO: 1392 - RNA, 19 nt, Artificial Sequence
  Synthetic siNA antisense region
gaauaguaggcaaggcccg

SEQ ID NO: 1393 - RNA, 23 nt, Artificial Sequence
  Synthetic Target Sequence/siNA sense region
gguccuuucuuggaucaacccgc

SEQ ID NO: 1394 - RNA, 23 nt, Artificial Sequence
  Synthetic Target Sequence/siNA sense region
ugccccgggaggucucguagacc

SEQ ID NO: 1395 - RNA, 23 nt, Artificial Sequence
  Synthetic Target Sequence/siNA sense region
ugcggaaccggugaguacaccgg

SEQ ID NO: 1396 - RNA, 23 nt, Artificial Sequence
  Synthetic Target Sequence/siNA sense region
gugccccgggaggucucguagac

SEQ ID NO: 1397 - RNA, 23 nt, Artificial Sequence
  Synthetic Target Sequence/siNA sense region
gcggaaccggugaguacaccgga

SEQ ID NO: 1398 - RNA, 23 nt, Artificial Sequence
  Synthetic Target Sequence/siNA sense region
uugugguacugccugauagggug

SEQ ID NO: 1399 - RNA, 23 nt, Artificial Sequence
  Synthetic Target Sequence/siNA sense region
cuugugguacugccugauagggu

SEQ ID NO: 1400 - RNA, 23 nt, Artificial Sequence
  Synthetic Target Sequence/siNA sense region
ccuugugguacugccugauaggg

SEQ ID NO: 1401 - RNA, 23 nt, Artificial Sequence
  Synthetic Target Sequence/siNA sense region
auaguggucugcggaaccgguga

SEQ ID NO: 1402 - RNA, 23 nt, Artificial Sequence
  Synthetic Target Sequence/siNA sense region
gucugcggaaccggugaguacac

SEQ ID NO: 1403 - RNA, 23 nt, Artificial Sequence
  Synthetic Target Sequence/siNA sense region
gccuugugguacugccugauagg

SEQ ID NO: 1404 - RNA, 23 nt, Artificial Sequence
  Synthetic Target Sequence/siNA sense region
ugugguacugccugauagggugc

SEQ ID NO: 1405 - RNA, 23 nt, Artificial Sequence
  Synthetic Target Sequence/siNA sense region
gugguacugccugauagggugcu

SEQ ID NO: 1406 - RNA, 23 nt, Artificial Sequence
  Synthetic Target Sequence/siNA sense region
ugguacugccugauagggugcuu

SEQ ID NO: 1407 - RNA, 23 nt, Artificial Sequence
  Synthetic Target Sequence/siNA sense region
gguacugccugauagggugcuug

SEQ ID NO: 1408 - RNA, 23 nt, Artificial Sequence
  Synthetic Target Sequence/siNA sense region
uacugccugauagggugcuugcg

SEQ ID NO: 1409 - RNA, 23 nt, Artificial Sequence
  Synthetic Target Sequence/siNA sense region
acugccugauagggugcuugcga

SEQ ID NO: 1410 - RNA, 23 nt, Artificial Sequence
  Synthetic Target Sequence/siNA sense region
ugccugauagggugcuugcgagu

SEQ ID NO: 1411 - RNA, 23 nt, Artificial Sequence
  Synthetic Target Sequence/siNA sense region
cugauagggugcuugcgagugcc

SEQ ID NO: 1412 - RNA, 23 nt, Artificial Sequence
  Synthetic Target Sequence/siNA sense region
aaaggccuugugguacugccuga

SEQ ID NO: 1413 - RNA, 21 nt, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
gguccuuucuuggaucaaccc

SEQ ID NO: 1414 - RNA, 21 nt, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
ggguugauccaagaaaggacc

SEQ ID NO: 1415 - RNA, 21 nt, Artificial Sequence
  Synthetic inverted control
  misc_feature (1)..(1): 5'-3 attached terminal deoxyabasic moiety
  misc_feature (21)..(21): 3'-3 attached terminal deoxyabasic moiety
cccaacuagguucuuuccugg

SEQ ID NO: 1416 - RNA, 21 nt, Artificial Sequence
  Synthetic inverted control compliment
  misc_feature (1)..(1): 5'-3 attached terminal deoxyabasic moiety
  misc_feature (21)..(21): 3'-3 attached terminal deoxyabasic moiety
ccaggaaagaaccuaguuggg

SEQ ID NO: 1417 - RNA, 23 nt, Artificial Sequence
  Synthetic siNA sense region
gguccuuucuuggaucaacccuu

SEQ ID NO: 1418 - RNA, 23 nt, Artificial Sequence
  Synthetic siNA antisense region
ggguugauccaagaaaggaccuu

SEQ ID NO: 1419 - RNA, 23 nt, Artificial Sequence
  Synthetic siNA sense region
  misc_feature (1)..(1): 5'-3 attached terminal deoxyabasic moiety
  misc_feature (23)..(23): 2'-3 attached terminal deoxyabasic moiety
gguccuuucuuggaucaacccuu

SEQ ID NO: 1420 - RNA, 23 nt, Artificial Sequence
  Synthetic siNA antisense region
  misc_feature (1)..(1): 5'-3 attached terminal deoxyabasic moiety
  misc_feature (23)..(23): 3'-3 attached terminal deoxyabasic moiety
ggguugauccaagaaaggaccuu

SEQ ID NO: 1421 - DNA, 21 bp, Artificial Sequence
  Synthetic siNA sense region
  misc_feature (20)..(21): n stands for thymidine
  misc_feature (20)..(21): n stands for thymidine
ccccgggaggucucguagann

SEQ ID NO: 1422 - DNA, 21 bp, Artificial Sequence
  Synthetic siNA sense region
  misc_feature (20)..(21): n stands for thymidine
cggaaccggugaguacaccnn

SEQ ID NO: 1423 - DNA, 21 bp, Artificial Sequence
  Synthetic siNA sense region
  misc_feature (20)..(21): n stands for thymidine
gccccgggaggucucguagnn

SEQ ID NO: 1424 - DNA, 21 bp, Artificial Sequence
  Synthetic siNA sense region
  misc_feature (20)..(21): n stands for thymidine
ggaaccggugaguacaccgnn

SEQ ID NO: 1425 - DNA, 21 bp, Artificial Sequence
  Synthetic siNA sense region
  misc_feature (20)..(21): n stands for thymidine
gugguacugccugauagggnn

SEQ ID NO: 1426 - DNA, 21 bp, Artificial Sequence
  Synthetic siNA sense region
  misc_feature (20)..(21): n stands for thymidine
ugugguacugccugauaggnn

SEQ ID NO: 1427 - DNA, 21 bp, Artificial Sequence
  Synthetic siNA sense region
  misc_feature (20)..(21): n stands for thymidine
uugugguacugccugauagnn

SEQ ID NO: 1428 - DNA, 21 bp, Artificial Sequence
  Synthetic siNA antisense region
  misc_feature (20)..(21): n stands for thymidine
ucuacgagaccucccggggnn

SEQ ID NO: 1429 - DNA, 21 bp, Artificial Sequence
  Synthetic siNA antisense region
  misc_feature (20)..(21): n stands for thymidine
gguguacucaccgguuccgnn

SEQ ID NO: 1430 - DNA, 21 bp, Artificial Sequence
  Synthetic siNA antisense region
  misc_feature (20)..(21): n stands for thymidine
cuacgagaccucccggggcnn

SEQ ID NO: 1431 - DNA, 21 bp, Artificial Sequence
  Synthetic siNA antisense region
  misc_feature (20)..(21): n stands for thymidine
cgguguacucaccgguuccnn

SEQ ID NO: 1432 - DNA, 21 bp, Artificial Sequence
  Synthetic siNA antisense region
  misc_feature (20)..(21): n stands for thymidine
cccuaucaggcaguaccacnn

SEQ ID NO: 1433 - DNA, 21 bp, Artificial Sequence
  Synthetic siNA antisense region
  misc_feature (20)..(21): n stands for thymidine
ccuaucaggcaguaccacann

SEQ ID NO: 1434 - DNA, 21 bp, Artificial Sequence
  Synthetic siNA antisense region
  misc_feature (20)..(21): n stands for thymidine
cuaucaggcaguaccacaann

SEQ ID NO: 1435 - DNA, 21 bp, Artificial Sequence
  Synthetic siNA sense region
  misc_feature (1)..(2): n stands for thymidine
nnagaugcucuggagggcccc

SEQ ID NO: 1436 - DNA, 21 bp, Artificial Sequence
  Synthetic siNA sense region
  misc_feature (1)..(2): n stands for thymidine
nnccacaugaguggccaaggc

SEQ ID NO: 1437 - DNA, 21 bp, Artificial Sequence
  Synthetic siNA sense region
  misc_feature (1)..(2): n stands for thymidine
nngaugcucuggagggccccg

SEQ ID NO: 1438 - DNA, 21 bp, Artificial Sequence
  Synthetic siNA sense region
  misc_feature (1)..(2): n stands for thymidine
nngccacaugaguggccaagg

SEQ ID NO: 1439 - DNA, 21 bp, Artificial Sequence
  Synthetic siNA sense region
  misc_feature (1)..(2): n stands for thymidine
nngggauaguccgucauggug

SEQ ID NO: 1440 - DNA, 21 bp, Artificial Sequence
  Synthetic siNA sense region
  misc_feature (1)..(2): n stands for thymidine
nnggauaguccgucauggugu

SEQ ID NO: 1441 - DNA, 21 bp, Artificial Sequence
  Synthetic siNA sense region
  misc_feature (1)..(2): n stands for thymidine
nngauaguccgucaugguguu

SEQ ID NO: 1442 - DNA, 21 bp, Artificial Sequence
  Synthetic siNA antisense region
  misc_feature (1)..(2): n stands for thymidine
nnggggcccuccagagcaucu

SEQ ID NO: 1443 - DNA, 21 bp, Artificial Sequence
  Synthetic siNA antisense region
  misc_feature (1)..(2): n stands for thymidine
nngccuuggccacucaugugg

SEQ ID NO: 1444 - DNA, 21 bp, Artificial Sequence
  Synthetic siNA antisense region
  misc_feature (1)..(2): n stands for thymidine
nncggggcccuccagagcauc

SEQ ID NO: 1445 - DNA, 21 bp, Artificial Sequence
  Synthetic siNA antisense region
  misc_feature (1)..(2): n stands for thymidine
nnccuuggccacucauguggc

SEQ ID NO: 1446 - DNA, 21 bp, Artificial Sequence
  Synthetic siNA antisense region
  misc_feature (1)..(2): n stands for thymidine
nncaccaugacggacuauccc

SEQ ID NO: 1447 - DNA, 21 bp, Artificial Sequence
  siNA sntisense region
  misc_feature (1)..(2): n stands for thymidine
nnacaccaugacggacuaucc

SEQ ID NO: 1448 - DNA, 21 bp, Artificial Sequence
  Synthetic siNA antisense region
  misc_feature (1)..(2): n stands for thymidine
nnaacaccaugacggacuauc

SEQ ID NO: 1449 - RNA, 21 nt, Artificial Sequence
  Synthetic siNA sense region
cggaaccggugaguacaccgg

SEQ ID NO: 1450 - RNA, 21 nt, Artificial Sequence
  Synthetic siNA sense region
ggaaccggugaguacaccgga

SEQ ID NO: 1451 - RNA, 21 nt, Artificial Sequence
  Synthetic siNA sense region
uugugguacugccugauaggg

SEQ ID NO: 1452 - RNA, 21 nt, Artificial Sequence
  Synthetic siNA sense region
ugugguacugccugauagggu

SEQ ID NO: 1453 - RNA, 21 nt, Artificial Sequence
  Synthetic siNA sense region
gugguacugccugauagggug

SEQ ID NO: 1454 - RNA, 21 nt, Artificial Sequence
  Synthetic siNA sense region
gccccgggaggucucguagac

SEQ ID NO: 1455 - RNA, 21 nt, Artificial Sequence
  Synthetic siNA sense region
ccccgggaggucucguagacc

SEQ ID NO: 1456 - RNA, 21 nt, Artificial Sequence
  Synthetic siNA antisense region
gguguacucaccgguuccgca

SEQ ID NO: 1457 - RNA, 21 nt, Artificial Sequence
  Synthetic siNA antisense region
cgguguacucaccgguuccgc

SEQ ID NO: 1458 - RNA, 21 nt, Artificial Sequence
  Synthetic siNA antisense region
cuaucaggcaguaccacaagg

SEQ ID NO: 1459 - RNA, 21 nt, Artificial Sequence
  Synthetic siNA antisense region
ccuaucaggcaguaccacaag

SEQ ID NO: 1460 - RNA, 21 nt, Artificial Sequence
  Synthetic siNA antisense region
cccuaucaggcaguaccacaa

SEQ ID NO: 1461 - RNA, 21 nt, Artificial Sequence
  Synthetic siNA antisense region
cuacgagaccucccggggcac

SEQ ID NO: 1462 - RNA, 21 nt, Artificial Sequence
  Synthetic siNA antisense region
ucuacgagaccucccggggca

SEQ ID NO: 1463 - RNA, 21 nt, Artificial Sequence
  Synthetic siNA sense region
ggccacaugaguggccaaggc

SEQ ID NO: 1464 - RNA, 21 nt, Artificial Sequence
  Synthetic siNA sense region
aggccacaugaguggccaagg

SEQ ID NO: 1465 - RNA, 21 nt, Artificial Sequence
  Synthetic siNA sense region
gggauaguccgucaugguguu

SEQ ID NO: 1466 - RNA, 21 nt, Artificial Sequence
  Synthetic siNA sense region
ugggauaguccgucauggugu

SEQ ID NO: 1467 - RNA, 21 nt, Artificial Sequence
  Synthetic siNA sense region
gugggauaguccgucauggug

SEQ ID NO: 1468 - RNA, 21 nt, Artificial Sequence
  Synthetic siNA sense region
cagaugcucuggagggccccg

SEQ ID NO: 1469 - RNA, 21 nt, Artificial Sequence
  Synthetic siNA sense region
ccagaugcucuggagggcccc

SEQ ID NO: 1470 - RNA, 21 nt, Artificial Sequence
  Synthetic siNA antisense region
acgccuuggccacucaugugg

SEQ ID NO: 1471 - RNA, 21 nt, Artificial Sequence
  Synthetic siNA antisense region
cgccuuggccacucauguggc

SEQ ID NO: 1472 - RNA, 21 nt, Artificial Sequence
  Synthetic siNA antisense region
ggaacaccaugacggacuauc

SEQ ID NO: 1473 - RNA, 21 nt, Artificial Sequence
  Synthetic siNA antisense region
gaacaccaugacggacuaucc

SEQ ID NO: 1474 - RNA, 21 nt, Artificial Sequence
  Synthetic siNA antisense region
aacaccaugacggacuauccc

SEQ ID NO: 1475 - RNA, 21 nt, Artificial Sequence
  Synthetic siNA antisense region
cacggggcccuccagagcauc

SEQ ID NO: 1476 - RNA, 21 nt, Artificial Sequence
  Synthetic siNA antisense region
acggggcccuccagagcaucu

SEQ ID NO: 1477 - RNA, 21 nt, Artificial Sequence
  Synthetic siNA sense region
  misc_feature (1)..(1): 5'-3 attached terminal deoxyabasic moiety
  misc_feature (1)..(5): Phosphorothioate 3'-Internucleotide Linkage
  misc_feature (20)..(21): n stands for 5'-nitroindole
  misc_feature (21)..(21): 3'-3 attached terminal deoxyabasic moiety
ccccgggaggucucguagann

SEQ ID NO: 1478 - RNA, 21 nt, Artificial Sequence
  Synthetic siNA sense region
  misc_feature (1)..(1): 5'-3 attached terminal deoxyabasic moiety
  misc_feature (1)..(5): Phosphorothioate 3'-Internucleotide Linkage
  misc_feature (20)..(21): n stands for 5'-nitroindole
  misc_feature (21)..(21): 3'-3 attached terminal deoxyabasic moiety
agaugcucuggagggccccnn

SEQ ID NO: 1479 - RNA, 21 nt, Artificial Sequence
  Synthetic siNA antisense region
  misc_feature (1)..(5): Phosphorothioate 3'-Internucleotide Linkage
  misc_feature (20)..(21): n stands for 5'-nitroindole
  misc_feature (21)..(21): 3'-3 attached terminal deoxyabasic moiety
ucuacgagaccucccggggnn

SEQ ID NO: 1480 - RNA, 21 nt, Artificial Sequence
  Synthetic siNA antisense region
  misc_feature (1)..(5): Phosphorothioate 3'-Internucleotide Linkage
  misc_feature (20)..(21): n stands for 5'-nitroindole
  misc_feature (21)..(21): 3'-3 attached terminal deoxyabasic moiety
ggggcccuccagagcaucunn

SEQ ID NO: 1481 - RNA, 21 nt, Artificial Sequence
  Synthetic siNA sense region
  misc_feature (1)..(4): Phosphorothioate 3'-Internucleotide Linkage
  misc_feature (11)..(14): Phosphorothioate 3'-Internucleotide Linkage
  misc_feature (16)..(16): Phosphorothioate 3'-Internucleotide Linkage
  misc_feature (20)..(21): n stands for 5'-nitroindole
  misc_feature (21)..(21): 3'-3 attached terminal deoxyabasic moiety
ccccgggaggucucguagann

SEQ ID NO: 1482 - RNA, 21 nt, Artificial Sequence
  Synthetic siNA sense region
  misc_feature (1)..(1): 5'-3 attached terminal deoxyabasic moiety
  misc_feature (4)..(4): Phosphorothioate 3'-Internucleotide Linkage
  misc_feature (6)..(9): Phosphorothioate 3'-Internucleotide Linkage
  misc_feature (16)..(19): Phosphorothioate 3'-Internucleotide Linkage
  misc_feature (20)..(21): n stands for 5'-nitroindole
  misc_feature (21)..(21): 3'-3 attached terminal deoxyabasic moiety
agaugcucuggagggccccnn

SEQ ID NO: 1483 - RNA, 21 nt, Artificial Sequence
  Synthetic siNA antisense region
  misc_feature (1)..(3): Phosphorothioate 3'-Internucleotide Linkage
  misc_feature (5)..(5): Phosphorothioate 3'-Internucleotide Linkage
  misc_feature (10)..(15): Phosphorothioate 3'-Internucleotide Linkage
  misc_feature (20)..(21): n stands for 5'-nitroindole
  misc_feature (21)..(21): 3'-3 attached terminal deoxyabasic moiety
ucuacgagaccucccggggnn

SEQ ID NO: 1484 - RNA, 21 nt, Artificial Sequence
  Synthetic siNA antisense region
  misc_feature (6)..(10): Phosphorothioate 3'-Internucleotide Linkage
  misc_feature (15)..(15): Phosphorothioate 3'-Internucleotide Linkage
  misc_feature (17)..(19): Phosphorothioate 3'-Internucleotide Linkage
  misc_feature (20)..(21): n stands for 5'-nitroindole
  misc_feature (21)..(21): 3'-3 attached terminal deoxyabasic moiety
ggggcccuccagagcaucunn

SEQ ID NO: 1485 - RNA, 21 nt, Artificial Sequence
  Synthetic siNA sense region
  misc_feature (1)..(1): 5'-3 attached terminal deoxyabasic moiety
  misc_feature (1)..(4): 2'-deoxy-2'-fluoro
  misc_feature (1)..(4): Phosphorothioate 3'-Internucleotide Linkage
  misc_feature (11)..(14): 2'-deoxy-2'-fluoro
  misc_feature (16)..(16): 2'-deoxy-2'-fluoro
  misc_feature (17)..(19): Phosphorothioate 3'-Internucleotide Linkage
  misc_feature (20)..(21): n stands for 5'-nitroindole
  misc_feature (21)..(21): 3'-3 attached terminal deoxyabasic moiety
ccccgggaggucucguagann

SEQ ID NO: 1486 - RNA, 21 nt, Artificial Sequence
  Synthetic siNA sense region
  misc_feature (1)..(1): Phosphorothioate 3'-Internucleotide Linkage
  misc_feature (1)..(1): 5'-3 attached terminal deoxyabasic moiety
  misc_feature (3)..(4): Phosphorothioate 3'-Internucleotide Linkage
  misc_feature (4)..(4): 2'-deoxy-2'-fluoro
  misc_feature (6)..(9): 2'-deoxy-2'-fluoro
  misc_feature (16)..(19): 2'-deoxy-2'-fluoro
  misc_feature (17)..(19): Phosphorothioate 3'-Internucleotide Linkage
  misc_feature (20)..(21): n stands for 5'-nitroindole
  misc_feature (21)..(21): 3'-3 attached terminal deoxyabasic moiety
agaugcucuggagggccccnn

SEQ ID NO: 1487 - RNA, 21 nt, Artificial Sequence
  Synthetic siNA sense region
  misc_feature (1)..(1): 5'-3 attached terminal deoxyabasic moiety
  misc_feature (1)..(4): 2'-deoxy-2'-fluoro
  misc_feature (11)..(14): 2'-deoxy-2'-fluoro
  misc_feature (16)..(16): 2'-deoxy-2'-fluoro
  misc_feature (20)..(21): n stands for 5'-nitroindole
  misc_feature (21)..(21): 3'-3 attached terminal deoxyabasic moiety
ccccgggaggucucguagann

SEQ ID NO: 1488 - RNA, 21 nt, Artificial Sequence
  Synthetic siNA sense region
  misc_feature (1)..(1): 5'-3 attached terminal deoxyabasic moiety
  misc_feature (4)..(4): 2'-deoxy-2'-fluoro
  misc_feature (6)..(9): 2'-deoxy-2'-fluoro
  misc_feature (16)..(19): 2'-deoxy-2'-fluoro
  misc_feature (20)..(21): n stands for 5'-nitroindole
  misc_feature (21)..(21): 3'-3 attached terminal deoxyabasic moiety
agaugcucuggagggccccnn

SEQ ID NO: 1489 - RNA, 21 nt, Artificial Sequence
  Synthetic siNA antisense region
  misc_feature (1)..(1): 5'-3 attached terminal deoxyabasic moiety
  misc_feature (1)..(3): Phosphorothioate 3'-Internucleotide Linkage
  misc_feature (5)..(5): Phosphorothioate 3'-Internucleotide Linkage
  misc_feature (10)..(12): Phosphorothioate 3'-Internucleotide Linkage
  misc_feature (13)..(15): Phosphorothioate 3'-Internucleotide Linkage
  misc_feature (20)..(21): n stands for 5'-nitroindole
  misc_feature (21)..(21): 3'-3 attached terminal deoxyabasic moiety
ucuacgagaccucccggggnn

SEQ ID NO: 1490 - RNA, 19 nt, Artificial Sequence
  Synthetic siNA antisense region
  misc_feature (1)..(3): 2'-deoxy-2'-fluoro
  misc_feature (5)..(5): 2'-deoxy-2'-fluoro
  misc_feature (10)..(15): 2'-deoxy-2'-fluoro
ucuacgagaccucccgggg

SEQ ID NO: 1491 - RNA, 21 nt, Artificial Sequence
  Synthetic siNA antisense region
  misc_feature (1)..(3): 2'-deoxy-2'-fluoro
  misc_feature (5)..(5): 2'-deoxy-2'-fluoro
  misc_feature (10)..(15): 2'-deoxy-2'-fluoro
  misc_feature (20)..(21): n stands for 5'-nitroindole
ucuacgagaccucccggggnn

SEQ ID NO: 1492 - RNA, 21 nt, Artificial Sequence
  Synthetic siNA antisense region
  misc_feature (5)..(10): 2'-deoxy-2'-fluoro
  misc_feature (15)..(15): 2'-deoxy-2'-fluoro
  misc_feature (17)..(19): 2'-deoxy-2'-fluoro
  misc_feature (20)..(21): n stands for 5'-nitroindole
ggggcccuccagagcaucunn

SEQ ID NO: 1493 - RNA, 21 nt, Artificial Sequence
  Synthetic siNA antisense region
  misc_feature (1)..(3): 2'-deoxy-2'-fluoro
  misc_feature (1)..(1): 5'-3 attached terminal deoxyabasic moiety
  misc_feature (5)..(5): 2'-deoxy-2'-fluoro
  misc_feature (10)..(15): 2'-deoxy-2'-fluoro
  misc_feature (20)..(21): n stands for 5'-nitroindole
  misc_feature (21)..(21): 3'-3 attached terminal deoxyabasic moiety
ucuacgagaccucccggggnn

SEQ ID NO: 1494 - RNA, 21 nt, Artificial Sequence
  Synthetic siNA sense region
  misc_feature (1)..(4): Phosphorothioate 3'-Internucleotide Linkage
  misc_feature (11)..(14): Phosphorothioate 3'-Internucleotide Linkage
  misc_feature (16)..(16): Phosphorothioate 3'-Internucleotide Linkage
  misc_feature (20)..(21): n stands for 5'-nitroindole
  misc_feature (21)..(21): 3'-3 attached terminal deoxyabasic moiety
ccccgggaggucucguagann

SEQ ID NO: 1495 - RNA, 21 nt, Artificial Sequence
  Synthetic siNA sense region
  misc_feature (21)..(21): 3'-3 attached terminal deoxyabasic moiety
ccccgggaggucucguagacc

SEQ ID NO: 1496 - RNA, 21 nt, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
ccccgggaggucucguagacc

SEQ ID NO: 1497 - RNA, 21 nt, Artificial Sequence
  Synthetic siNA antisense region
  misc_feature (21)..(21): 3'-3 attached terminal deoxyabasic moiety
ucuacgagaccucccggggca

SEQ ID NO: 1498 - RNA, 21 nt, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
ucuacgagaccucccggggca

SEQ ID NO: 1499 - DNA, 21 bp, Artificial Sequence
  Synthetic siNA sense region
  misc_feature (1)..(1): 5'-3 attached terminal deoxyabasic moiety
  misc_feature (1)..(4): 2'-deoxy-2'-fluoro
  misc_feature (11)..(14): 2'-deoxy-2'-fluoro
  misc_feature (16)..(16): 2'-deoxy-2'-fluoro
  misc_feature (20)..(21): n stands for thymidine
  misc_feature (21)..(21): 3'-3 attached terminal deoxyabasic moiety
ccccgggaggucucguagann

SEQ ID NO: 1500 - DNA, 21 bp, Artificial Sequence
  Synthetic siNA antisense region
  misc_feature (1)..(3): 2'-deoxy-2'-fluoro
  misc_feature (5)..(5): 2'-deoxy-2'-fluoro
  misc_feature (10)..(15): 2'-deoxy-2'-fluoro
  misc_feature (20)..(21): n stands for thymidine
  misc_feature (20)..(20): Phosphorothioate 3'-Internucleotide Linkage
ucuacgagaccucccggggnn

SEQ ID NO: 1501 - DNA, 21 bp, Artificial Sequence
  Synthetic siNA sense region
  misc_feature (1)..(2): 2'-deoxy
  misc_feature (1)..(1): 5'-3 attached terminal deoxyabasic moiety
  misc_feature (3)..(3): 2'-deoxy-2'-fluoro
  misc_feature (4)..(5): 2'-deoxy
  misc_feature (6)..(8): 2'-deoxy-2'-fluoro
  misc_feature (9)..(9): 2'-deoxy
  misc_feature (10)..(10): 2'-deoxy-2'-fluoro
  misc_feature (11)..(14): 2'-deoxy
  misc_feature (17)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
aguggucugcggaaccggunn

SEQ ID NO: 1502 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(8): 2'-deoxy
  misc_feature (9)..(10): 2'-deoxy-2'-fluoro
  misc_feature (11)..(12): 2'-deoxy
  misc_feature (13)..(13): 2'-deoxy-2'-fluoro
  misc_feature (14)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
cugcggaaccggugaguacnn

SEQ ID NO: 1503 - RNA, 21 nt, Artificial Sequence
  Synthetic siNA sense region
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(7): 2'-deoxy
  misc_feature (8)..(8): 2'-deoxy-2'-fluoro
  misc_feature (9)..(9): 2'-deoxy
  misc_feature (10)..(11): 2'-deoxy-2'-fluoro
  misc_feature (12)..(12): 2'-deoxy
  misc_feature (13)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (20)..(21)
  misc_feature (20)..(20): n is a, c, g, or u
  misc_feature (21)..(21): 3'-3 attached terminal deoxyabasic moiety
cuugugguacugccugauann

SEQ ID NO: 1504 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(3): 2'-deoxy
  misc_feature (4)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(11): 2'-deoxy-2'-fluoro
  misc_feature (12)..(13): 2'-deoxy
  misc_feature (14)..(14): 2'-deoxy-2'-fluoro
  misc_feature (15)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
ugguacugccugauagggunn

SEQ ID NO: 1505 - DNA, 21 bp, Artificial Sequence
  Synthetic siNA sense region
  misc_feature (1)..(2): 2'-deoxy
  misc_feature (1)..(1): 5'-3 attached terminal deoxyabasic moiety
  misc_feature (3)..(3): 2'-deoxy-2'-fluoro
  misc_feature (4)..(4): 2'-deoxy
  misc_feature (5)..(6): 2'-deoxy-2'-fluoro
  misc_feature (7)..(7): 2'-deoxy
  misc_feature (8)..(10): 2'-deoxy-2'-fluoro
  misc_feature (11)..(12): 2'-deoxy
  misc_feature (13)..(13): 2'-deoxy-2'-fluoro
  misc_feature (14)..(17): 2'-deoxy
  misc_feature (18)..(18): 2'-deoxy-2'-fluoro
  misc_feature (19)..(19): 2'-deoxy
  misc_feature (20)..(21): n stands for thymidine
  misc_feature (21)..(21): 3'-3 attached terminal deoxyabasic moiety
gguacugccugauagggugnn

SEQ ID NO: 1506 - RNA, 21 nt, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(2): 2'-deoxy-2'-fluoro
  misc_feature (3)..(3): 2'-deoxy
  misc_feature (4)..(5): 2'-deoxy-2'-fluoro
  misc_feature (6)..(6): 2'-deoxy
  misc_feature (7)..(9): 2'-deoxy-2'-fluoro
  misc_feature (10)..(11): 2'-deoxy
  misc_feature (12)..(12): 2'-deoxy-2'-fluoro
  misc_feature (13)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (20)..(21)
  misc_feature (20)..(20): n is a, c, g, or u
  misc_feature (21)..(21): 5'-3 attached terminal deoxyabasic moiety
guacugccugauagggugcnn

SEQ ID NO: 1507 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (2)..(2): 2'-deoxy
  misc_feature (3)..(4): 2'-deoxy-2'-fluoro
  misc_feature (5)..(5): 2'-deoxy
  misc_feature (6)..(8): 2'-deoxy-2'-fluoro
  misc_feature (9)..(10): 2'-deoxy
  misc_feature (11)..(11): 2'-deoxy-2'-fluoro
  misc_feature (12)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (20)..(21): n stands for thymidine
  misc_feature (21)..(21): 3'-3 attached terminal deoxyabasic moiety
uacugccugauagggugcunn

SEQ ID NO: 1508 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (3)..(3): 2'-deoxy
  misc_feature (4)..(6): 2'-deoxy-2'-fluoro
  misc_feature (7)..(8): 2'-deoxy
  misc_feature (9)..(9): 2'-deoxy-2'-fluoro
  misc_feature (10)..(13): 2'-deoxy
  misc_feature (14)..(14): 2'-deoxy-2'-fluoro
  misc_feature (15)..(15): 2'-deoxy
  misc_feature (16)..(18): 2'-deoxy-2'-fluoro
  misc_feature (19)..(19): 2'-deoxy
  misc_feature (20)..(21): n stands for thymidine
  misc_feature (21)..(21): 5'-3 attached terminal deoxyabasic moiety
cugccugauagggugcuugnn

SEQ ID NO: 1509 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (2)..(2): 2'-deoxy
  misc_feature (3)..(5): 2'-deoxy-2'-fluoro
  misc_feature (6)..(7): 2'-deoxy
  misc_feature (8)..(8): 2'-deoxy-2'-fluoro
  misc_feature (9)..(12): 2'-deoxy
  misc_feature (13)..(13): 2'-deoxy-2'-fluoro
  misc_feature (14)..(14): 2'-deoxy
  misc_feature (15)..(17): 2'-deoxy-2'-fluoro
  misc_feature (18)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
ugccugauagggugcuugcnn

SEQ ID NO: 1510 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy-2'-fluoro
  misc_feature (4)..(5): 2'-deoxy
  misc_feature (6)..(6): 2'-deoxy-2'-fluoro
  misc_feature (7)..(10): 2'-deoxy
  misc_feature (11)..(11): 2'-deoxy-2'-fluoro
  misc_feature (12)..(12): 2'-deoxy
  misc_feature (13)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (20)..(21): n stands for thymidine
  misc_feature (21)..(21): 3'-3 attached terminal deoxyabasic moiety
ccugauagggugcuugcgann

SEQ ID NO: 1511 - DNA, 21 bp, Artificial Sequence
  Synthetic siNA sense region
  misc_feature (1)..(2): 2'-deoxy
  misc_feature (1)..(1): 5'-3 attached terminal deoxyabasic moiety
  misc_feature (3)..(3): 2'-deoxy-2'-fluoro
  misc_feature (4)..(7): 2'-deoxy
  misc_feature (8)..(8): 2'-deoxy-2'-fluoro
  misc_feature (9)..(9): 2'-deoxy
  misc_feature (10)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (20)..(21): n stands for thymidine
  misc_feature (21)..(21): 3'-3 attached terminal deoxyabasic moiety
gauagggugcuugcgagugnn

SEQ ID NO: 1512 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(5): 2'-deoxy-2'-fluoro
  misc_feature (6)..(11): 2'-deoxy
  misc_feature (12)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (20)..(21): n stands for thymidine
  misc_feature (21)..(21): 3'-3 attached terminal deoxyabasic moiety
gccccgggaggucucguagnn

SEQ ID NO: 1513 - DNA, 21 bp, Artificial Sequence
  Synthetic siNA antisense region
  misc_feature (1)..(1): 2'-O-methyl
  misc_feature (2)..(3): 2'-deoxy-2'-fluoro
  misc_feature (4)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(14): 2'-O-methyl
  misc_feature (15)..(16): 2'-deoxy-2'-fluoro
  misc_feature (17)..(17): 2'-O-methyl
  misc_feature (18)..(19): 2'-deoxy-2'-fluoro
  misc_feature (20)..(21): n stands for thymidine
  misc_feature (20)..(20): Phosphorothioate 3'-Internucleotide Linkage
accgguuccgcagaccacunn

SEQ ID NO: 1514 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(3): 2'-O-methyl
  misc_feature (4)..(6): 2'-deoxy-2'-fluoro
  misc_feature (7)..(7): 2'-O-methyl
  misc_feature (8)..(9): 2'-deoxy-2'-fluoro
  misc_feature (10)..(11): 2'-O-methyl
  misc_feature (12)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (20)..(21): n stands for thymidine
  misc_feature (20)..(20): Phosphorothioate 3'-Internucleotide Linkage
guacucaccgguuccgcagnn

SEQ ID NO: 1515 - DNA, 21 bp, Artificial Sequence
  Synthetic siNA antisense region
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (5)..(7): 2'-O-methyl
  misc_feature (8)..(8): 2'-deoxy-2'-fluoro
  misc_feature (9)..(10): 2'-O-methyl
  misc_feature (11)..(11): 2'-deoxy-2'-fluoro
  misc_feature (12)..(12): 2'-O-methyl
  misc_feature (13)..(13): 2'-deoxy-2'-fluoro
  misc_feature (15)..(15): 2'-O-methyl
  misc_feature (16)..(16): 2'-deoxy-2'-fluoro
  misc_feature (17)..(19): 2'-O-methyl
  misc_feature (20)..(21): n stands for thymidine
  misc_feature (20)..(20): Phosphorothioate 3'-Internucleotide Linkage
uaucaggcaguaccacaagnn

SEQ ID NO: 1516 - DNA, 21 bp, Artificial Sequence
  Synthetic siNA antisense region
  misc_feature (1)..(1): 2'-O-methyl
  misc_feature (2)..(5): 2'-deoxy-2'-fluoro
  misc_feature (6)..(6): 2'-O-methyl
  misc_feature (7)..(8): 2'-deoxy-2'-fluoro
  misc_feature (9)..(11): 2'-O-methyl
  misc_feature (12)..(12): 2'-deoxy-2'-fluoro
  misc_feature (13)..(14): 2'-O-methyl
  misc_feature (15)..(15): 2'-deoxy-2'-fluoro
  misc_feature (16)..(16): 2'-O-methyl
  misc_feature (17)..(18): 2'-deoxy-2'-fluoro
  misc_feature (19)..(19): 2'-O-methyl
  misc_feature (20)..(20): Phosphorothioate 3'-Internucleotide Linkage
  misc_feature (20)..(21): n stands for thymidine
acccuaucaggcaguaccann

SEQ ID NO: 1517 - DNA, 21 bp, Artificial Sequence
  Synthetic siNA antisense region
  misc_feature (1)..(1): 2'-deoxy-2'-fluoro
  misc_feature (2)..(2): 2'-O-methyl
  misc_feature (3)..(6): 2'-deoxy-2'-fluoro
  misc_feature (7)..(7): 2'-O-methyl
  misc_feature (8)..(9): 2'-deoxy-2'-fluoro
  misc_feature (10)..(12): 2'-O-methyl
  misc_feature (13)..(13): 2'-deoxy-2'-fluoro
  misc_feature (14)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): n stands for thymidine
  misc_feature (20)..(20): Phosphorothioate 3'-Internucleotide Linkage
cacccuaucaggcaguaccnn

SEQ ID NO: 1518 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(3): 2'-O-methyl
  misc_feature (4)..(7): 2'-deoxy-2'-fluoro
  misc_feature (8)..(8): 2'-O-methyl
  misc_feature (9)..(10): 2'-deoxy-2'-fluoro
  misc_feature (11)..(13): 2'-O-methyl
  misc_feature (14)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (20)..(21): n stands for thymidine
gcacccuaucaggcaguacnn

SEQ ID NO: 1519 - DNA, 21 bp, Artificial Sequence
  Synthetic siNA antisense region
  misc_feature (1)..(2): 2'-O-methyl
  misc_feature (3)..(3): 2'-deoxy-2'-fluoro
  misc_feature (4)..(4): 2'-O-methyl
  misc_feature (5)..(8): 2'-deoxy-2'-fluoro
  misc_feature (9)..(9): 2'-O-methyl
  misc_feature (10)..(11): 2'-deoxy-2'-fluoro
  misc_feature (12)..(14): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (20)..(21): n stands for thymidine
  misc_feature (20)..(20): Phosphorothioate 3'-Internucleotide Linkage
agcacccuaucaggcaguann

SEQ ID NO: 1520 - DNA, 21 bp, Artificial Sequence
  Synthetic siNA antisense region
  misc_feature (1)..(1): 2'-deoxy-2'-fluoro
  misc_feature (2)..(4): 2'-O-methyl
  misc_feature (5)..(5): 2'-deoxy-2'-fluoro
  misc_feature (6)..(6): 2'-O-methyl
  misc_feature (7)..(10): 2'-deoxy-2'-fluoro
  misc_feature (11)..(11): 2'-O-methyl
  misc_feature (12)..(13): 2'-deoxy-2'-fluoro
  misc_feature (14)..(16): 2'-O-methyl
  misc_feature (17)..(17): 2'-deoxy-2'-fluoro
  misc_feature (18)..(19): 2'-O-methyl
  misc_feature (20)..(20): Phosphorothioate 3'-Internucleotide Linkage
  misc_feature (20)..(21): n stands for thymidine
caagcacccuaucaggcagnn

SEQ ID NO: 1521 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(5): 2'-O-methyl
  misc_feature (6)..(6): 2'-deoxy-2'-fluoro
  misc_feature (7)..(7): 2'-O-methyl
  misc_feature (8)..(11): 2'-deoxy-2'-fluoro
  misc_feature (12)..(12): 2'-O-methyl
  misc_feature (13)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (20)..(21): n stands for thymidine
gcaagcacccuaucaggcann

SEQ ID NO: 1522 - DNA, 21 bp, Artificial Sequence
  Synthetic siNA antisense region
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(9): 2'-O-methyl
  misc_feature (10)..(13): 2'-deoxy-2'-fluoro
  misc_feature (14)..(14): 2'-O-methyl
  misc_feature (15)..(16): 2'-deoxy-2'-fluoro
  misc_feature (17)..(19): 2'-O-methyl
  misc_feature (20)..(21): n stands for thymidine
  misc_feature (20)..(20): Phosphorothioate 3'-Internucleotide Linkage
ucgcaagcacccuaucaggnn

SEQ ID NO: 1523 - DNA, 21 bp, Artificial Sequence
  Synthetic siNA antisense region
  misc_feature (2)..(2): 2'-O-methyl
  misc_feature (3)..(5): 2'-deoxy-2'-fluoro
  misc_feature (6)..(6): 2'-O-methyl
  misc_feature (7)..(7): 2'-deoxy-2'-fluoro
  misc_feature (8)..(10): 2'-O-methyl
  misc_feature (11)..(11): 2'-deoxy-2'-fluoro
  misc_feature (12)..(12): 2'-O-methyl
  misc_feature (13)..(16): 2'-deoxy-2'-fluoro
  misc_feature (17)..(17): 2'-O-methyl
  misc_feature (18)..(19): 2'-deoxy-2'-fluoro
  misc_feature (20)..(20): Phosphorothioate 3'-Internucleotide Linkage
  misc_feature (20)..(21): stands for thymidine
  misc_feature (20)..(21): n stands for thymidine
cacucgcaagcacccuaucnn

SEQ ID NO: 1524 - DNA, 21 bp, Artificial Sequence
  Synthetic siNA antisense region
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(8): 2'-O-methyl
  misc_feature (9)..(14): 2'-deoxy-2'-fluoro
  misc_feature (15)..(18): 2'-O-methyl
  misc_feature (19)..(19): 2'-deoxy-2'-fluoro
  misc_feature (20)..(21): n stands for thymidine
  misc_feature (20)..(20): Phosphorothioate 3'-Internucleotide Linkage
cuacgagaccucccggggcnn

SEQ ID NO: 1525 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (2)..(3): 2'-deoxy
  misc_feature (4)..(5): 2'-deoxy-2'-fluoro
  misc_feature (6)..(9): 2'-deoxy
  misc_feature (10)..(10): 2'-deoxy-2'-fluoro
  misc_feature (11)..(11): 2'-deoxy
  misc_feature (12)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (20)..(21): n stands for thymidine
  misc_feature (21)..(21): 3'-3 attached terminal deoxyabasic moiety
uggccaaggcgucuggugann

SEQ ID NO: 1526 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (3)..(3): 2'-deoxy-2'-fluoro
  misc_feature (4)..(6): 2'-deoxy
  misc_feature (7)..(7): 2'-deoxy-2'-fluoro
  misc_feature (8)..(9): 2'-deoxy
  misc_feature (10)..(11): 2'-deoxy-2'-fluoro
  misc_feature (12)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (20)..(21): n stands for thymidine
  misc_feature (21)..(21): 3'-3 attached terminal deoxyabasic moiety
caugaguggccaaggcgucnn

SEQ ID NO: 1527 - DNA, 21 bp, Artificial Sequence
  Synthetic siNA sense region
  misc_feature (1)..(1): 2'-deoxy
  misc_feature (1)..(1): 5'-3 attached terminal deoxyabasic moiety
  misc_feature (2)..(2): 2'-deoxy-2'-fluoro
  misc_feature (3)..(4): 2'-deoxy
  misc_feature (5)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (20)..(21): n stands for thymidine
  misc_feature (21)..(21): 3'-3 attached terminal deoxyabasic moiety
auaguccgucaugguguucnn

SEQ ID NO: 1528 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(5): 2'-deoxy
  misc_feature (6)..(6): 2'-deoxy-2'-fluoro
  misc_feature (7)..(8): 2'-deoxy
  misc_feature (9)..(11): 2'-deoxy-2'-fluoro
  misc_feature (12)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
ugggauaguccgucauggunn

SEQ ID NO: 1529 - DNA, 21 bp, Artificial Sequence
  Synthetic siNA sense region
  misc_feature (1)..(1): 2'-deoxy
  misc_feature (1)..(1): 5'-3 attached terminal deoxyabasic moiety
  misc_feature (2)..(2): 2'-deoxy-2'-fluoro
  misc_feature (3)..(6): 2'-deoxy
  misc_feature (7)..(7): 2'-deoxy-2'-fluoro
  misc_feature (8)..(9): 2'-deoxy
  misc_feature (10)..(12): 2'-deoxy-2'-fluoro
  misc_feature (13)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (17)..(17): 2'-deoxy
  misc_feature (18)..(19): 2'-deoxy
  misc_feature (20)..(21): n stands for thymidine
  misc_feature (21)..(21): 3'-3 attached terminal deoxyabasic moiety
gugggauaguccgucauggnn

SEQ ID NO: 1530 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(7): 2'-deoxy
  misc_feature (8)..(8): 2'-deoxy-2'-fluoro
  misc_feature (9)..(10): 2'-deoxy
  misc_feature (11)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (20)..(21): n stands for thymidine
  misc_feature (21)..(21): 3'-3 attached terminal deoxyabasic moiety
cgugggauaguccgucaugnn

SEQ ID NO: 1531 - DNA, 21 bp, Artificial Sequence
  Synthetic siNA sense region
  misc_feature (1)..(2): 2'-deoxy-2'-fluoro
  misc_feature (1)..(1): 5'-3 attached terminal deoxyabasic moiety
  misc_feature (3)..(3): 2'-deoxy
  misc_feature (4)..(4): 2'-deoxy-2'-fluoro
  misc_feature (5)..(8): 2'-deoxy
  misc_feature (9)..(9): 2'-deoxy-2'-fluoro
  misc_feature (10)..(11): 2'-deoxy
  misc_feature (12)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
ucgugggauaguccgucaunn

SEQ ID NO: 1532 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(4): 2'-deoxy-2'-fluoro
  misc_feature (5)..(5): 2'-deoxy
  misc_feature (6)..(6): 2'-deoxy-2'-fluoro
  misc_feature (7)..(10): 2'-deoxy
  misc_feature (11)..(11): 2'-deoxy-2'-fluoro
  misc_feature (12)..(13): 2'-deoxy
  misc_feature (14)..(16): 2'-deoxy-2'-fluoro
  misc_feature (17)..(17): 2'-deoxy
  misc_feature (18)..(19): 2'-deoxy-2'-fluoro
  misc_feature (20)..(21): n stands for thymidine
  misc_feature (21)..(21): 3'-3 attached terminal deoxyabasic moiety
guucgugggauaguccgucnn

SEQ ID NO: 1533 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (2)..(2): 2'-deoxy
  misc_feature (3)..(5): 2'-deoxy-2'-fluoro
  misc_feature (6)..(6): 2'-deoxy
  misc_feature (7)..(7): 2'-deoxy-2'-fluoro
  misc_feature (8)..(11): 2'-deoxy
  misc_feature (12)..(12): 2'-deoxy-2'-fluoro
  misc_feature (13)..(14): 2'-deoxy
  misc_feature (15)..(17): 2'-deoxy-2'-fluoro
  misc_feature (18)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
cguucgugggauaguccgunn

SEQ ID NO: 1534 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy
  misc_feature (3)..(3): 2'-deoxy-2'-fluoro
  misc_feature (4)..(4): 2'-deoxy
  misc_feature (5)..(7): 2'-deoxy-2'-fluoro
  misc_feature (8)..(8): 2'-deoxy
  misc_feature (9)..(9): 2'-deoxy-2'-fluoro
  misc_feature (10)..(13): 2'-deoxy
  misc_feature (14)..(14): 2'-deoxy-2'-fluoro
  misc_feature (15)..(16): 2'-deoxy
  misc_feature (17)..(19): 2'-deoxy-2'-fluoro
  misc_feature (20)..(21): n stands for thymidine
  misc_feature (21)..(21): 3'-3 attached terminal deoxyabasic moiety
agcguucgugggauaguccnn

SEQ ID NO: 1535 - DNA, 21 bp, Artificial Sequence
  Synthetic siNA sense region
  misc_feature (1)..(1): 2'-deoxy
  misc_feature (1)..(1): 5'-3 attached terminal deoxyabasic moiety
  misc_feature (2)..(2): 2'-deoxy-2'-fluoro
  misc_feature (3)..(5): 2'-deoxy
  misc_feature (6)..(6): 2'-deoxy-2'-fluoro
  misc_feature (7)..(7): 2'-deoxy
  misc_feature (8)..(10): 2'-deoxy-2'-fluoro
  misc_feature (11)..(11): 2'-deoxy
  misc_feature (12)..(12): 2'-deoxy-2'-fluoro
  misc_feature (13)..(16): 2'-deoxy
  misc_feature (17)..(17): 2'-deoxy-2'-fluoro
  misc_feature (18)..(19): 2'-deoxy
  misc_feature (20)..(21): n stands for thymidine
  misc_feature (21)..(21): 3'-3 attached terminal deoxyabasic moiety
gugagcguucgugggauagnn

SEQ ID NO: 1536 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy
  misc_feature (3)..(3): 2'-deoxy-2'-fluoro
  misc_feature (4)..(4): 2'-deoxy
  misc_feature (5)..(8): 2'-deoxy-2'-fluoro
  misc_feature (9)..(14): 2'-deoxy
  misc_feature (15)..(18): 2'-deoxy-2'-fluoro
  misc_feature (19)..(19): 2'-deoxy
  misc_feature (20)..(21): n stands for thymidine
  misc_feature (21)..(21): 3'-3 attached terminal deoxyabasic moiety
gaugcucuggagggccccgnn

SEQ ID NO: 1537 - DNA, 21 bp, Artificial Sequence
  Synthetic siNA antisense region
  misc_feature (1)..(2): 2'-deoxy-2'-fluoro
  misc_feature (3)..(3): 2'-O-methyl
  misc_feature (4)..(5): 2'-deoxy-2'-fluoro
  misc_feature (6)..(8): 2'-O-methyl
  misc_feature (9)..(9): 2'-deoxy-2'-fluoro
  misc_feature (10)..(10): 2'-O-methyl
  misc_feature (11)..(14): 2'-deoxy-2'-fluoro
  misc_feature (15)..(16): 2'-O-methyl
  misc_feature (17)..(18): 2'-deoxy-2'-fluoro
  misc_feature (19)..(19): 2'-O-methyl
  misc_feature (20)..(20): Phosphorothioate 3'-Internucleotide Linkage
  misc_feature (20)..(21): n stands for thymidine
ucaccagacgccuuggccann

SEQ ID NO: 1538 - DNA, 21 bp, Artificial Sequence
  Synthetic siNA antisense region
  misc_feature (1)..(2): 2'-O-methyl
  misc_feature (3)..(3): 2'-deoxy-2'-fluoro
  misc_feature (4)..(4): 2'-O-methyl
  misc_feature (5)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(21): n stands for thymidine
  misc_feature (20)..(20): Phosphorothioate 3'-Internucleotide Linkage
gacgccuuggccacucaugnn

SEQ ID NO: 1539 - DNA, 21 bp, Artificial Sequence
  Synthetic siNA antisense region
  misc_feature (1)..(3): 2'-O-methyl
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-deoxy-2'-fluoro
  misc_feature (20)..(21): n stands for thymidine
  misc_feature (20)..(20): Phosphorothioate 3'-Internucleotide Linkage
gaacaccaugacggacuaunn

SEQ ID NO: 1540 - DNA, 21 bp, Artificial Sequence
  Synthetic siNA antisense region
  misc_feature (1)..(1): 2'-O-methyl
  misc_feature (2)..(3): 2'-deoxy-2'-fluoro
  misc_feature (4)..(4): 2'-O-methyl
  misc_feature (5)..(5): 2'-deoxy-2'-fluoro
  misc_feature (6)..(7): 2'-O-methyl
  misc_feature (8)..(8): 2'-deoxy-2'-fluoro
  misc_feature (9)..(11): 2'-O-methyl
  misc_feature (12)..(13): 2'-deoxy-2'-fluoro
  misc_feature (14)..(14): 2'-O-methyl
  misc_feature (15)..(18): 2'-deoxy-2'-fluoro
  misc_feature (19)..(19): 2'-O-methyl
  misc_feature (20)..(20): Phosphorothioate 3'-Internucleotide Linkage
  misc_feature (20)..(21): n stands for thymidine
accaugacggacuaucccann

SEQ ID NO: 1541 - DNA, 21 bp, Artificial Sequence
  Synthetic siNA antisense region
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (20)..(21): n stands for thymidine
ccaugacggacuaucccacnn

SEQ ID NO: 1542 - DNA, 21 bp, Artificial Sequence
  Synthetic siNA antisense region
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (6)..(6): 2'-deoxy-2'-fluoro
  misc_feature (7)..(9): 2'-O-methyl
  misc_feature (10)..(11): 2'-deoxy-2'-fluoro
  misc_feature (12)..(12): 2'-O-methyl
  misc_feature (13)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(21): n stands for thymidine
  misc_feature (20)..(21): n stands for thymidine
caugacggacuaucccacgnn

SEQ ID NO: 1543 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(4): 2'-O-methyl
  misc_feature (5)..(5): 2'-deoxy-2'-fluoro
  misc_feature (6)..(8): 2'-O-methyl
  misc_feature (9)..(10): 2'-deoxy-2'-fluoro
  misc_feature (11)..(11): 2'-O-methyl
  misc_feature (12)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (20)..(20): Phosphorothioate 3'-Internucleotide Linkage
  misc_feature (20)..(21): n stands for thymidine
augacggacuaucccacgann

SEQ ID NO: 1544 - DNA, 21 bp, Artificial Sequence
  Synthetic siNA antisense region
  misc_feature (1)..(2): 2'-O-methyl
  misc_feature (3)..(3): 2'-deoxy-2'-fluoro
  misc_feature (4)..(6): 2'-O-methyl
  misc_feature (7)..(8): 2'-deoxy-2'-fluoro
  misc_feature (9)..(9): 2'-O-methyl
  misc_feature (10)..(13): 2'-deoxy-2'-fluoro
  misc_feature (14)..(14): 2'-O-methyl
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (20)..(21): n stands for thymidine
  misc_feature (20)..(20): Phosphorothioate 3'-Internucleotide Linkage
gacggacuaucccacgaacnn

SEQ ID NO: 1545 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(5): 2'-O-methyl
  misc_feature (6)..(7): 2'-deoxy-2'-fluoro
  misc_feature (8)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (20)..(21): n stands for thymidine
acggacuaucccacgaacgnn

SEQ ID NO: 1546 - DNA, 21 bp, Artificial Sequence
  Synthetic siNA antisense region
  misc_feature (1)..(3): 2'-O-methyl
  misc_feature (4)..(5): 2'-deoxy-2'-fluoro
  misc_feature (6)..(6): 2'-O-methyl
  misc_feature (7)..(10): 2'-deoxy-2'-fluoro
  misc_feature (11)..(11): 2'-O-methyl
  misc_feature (12)..(12): 2'-deoxy-2'-fluoro
  misc_feature (13)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): n stands for thymidine
  misc_feature (20)..(20): Phosphorothioate 3'-Internucleotide Linkage
ggacuaucccacgaacgcunn

SEQ ID NO: 1547 - DNA, 21 bp, Artificial Sequence
  Synthetic siNA antisense region
  misc_feature (1)..(2): 2'-deoxy-2'-fluoro
  misc_feature (4)..(7): 2'-deoxy-2'-fluoro
  misc_feature (9)..(9): 2'-deoxy-2'-fluoro
  misc_feature (13)..(13): 2'-deoxy-2'-fluoro
  misc_feature (15)..(17): 2'-deoxy-2'-fluoro
  misc_feature (19)..(19): 2'-deoxy-2'-fluoro
  misc_feature (19)..(19): 5'-3 attached terminal deoxyabasic moiety
  misc_feature (20)..(20): Phosphorothioate 3'-Internucleotide Linkage
  misc_feature (20)..(21): n stands for thymidine
cuaucccacgaacgcucacnn

SEQ ID NO: 1548 - DNA, 21 bp, Artificial Sequence
  Synthetic siNA antisense region
  misc_feature (1)..(1): 2'-deoxy-2'-fluoro
  misc_feature (2)..(5): 2'-O-methyl
  misc_feature (6)..(11): 2'-deoxy-2'-fluoro
  misc_feature (12)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): n stands for thymidine
  misc_feature (20)..(20): Phosphorothioate 3'-Internucleotide Linkage
cggggcccuccagagcaucnn

SEQ ID NO: 1549 - DNA, 21 bp, Artificial Sequence
  Synthetic siNA sense region
  misc_feature (1)..(4): 2'-deoxy-2'-fluoro
  misc_feature (1)..(1): 5'-3 attached terminal deoxyabasic moiety
  misc_feature (11)..(14): 2'-deoxy-2'-fluoro
  misc_feature (16)..(16): 2'-deoxy-2'-fluoro
  misc_feature (20)..(21): n stands for thymidine
  misc_feature (21)..(21): 3'-3 attached terminal deoxyabasic moiety
ccccgggaggucucguagann

SEQ ID NO: 1550 - DNA, 21 bp, Artificial Sequence
  Synthetic siNA sense region
  misc_feature (1)..(1): 5'-3 attached terminal deoxyabasic moiety
  misc_feature (4)..(4): 2'-deoxy-2'-fluoro
  misc_feature (6)..(9): 2'-deoxy-2'-fluoro
  misc_feature (16)..(19): 2'-deoxy-2'-fluoro
  misc_feature (20)..(21): n stands for thymidine
  misc_feature (21)..(21): 3'-3 attached terminal deoxyabasic moiety
agaugcucuggagggccccnn

SEQ ID NO: 1551 - DNA, 21 bp, Artificial Sequence
  Synthetic siNA antisense region
  misc_feature (1)..(3): 2'-deoxy-2'-fluoro
  misc_feature (5)..(5): 2'-deoxy-2'-fluoro
  misc_feature (10)..(15): 2'-deoxy-2'-fluoro
  misc_feature (20)..(21): n stands for thymidine
  misc_feature (20)..(20): Phosphorothioate 3'-Internucleotide Linkage
ucuacgagaccucccggggnn

SEQ ID NO: 1552 - DNA, 21 bp, Artificial Sequence
  Synthetic siNA antisense region
  misc_feature (5)..(10): 2'-deoxy-2'-fluoro
  misc_feature (15)..(15): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (20)..(21): n stands for thymidine
ggggcccuccagagcaucunn

SEQ ID NO: 1553 - DNA, 21 bp, Artificial Sequence
  Synthetic siNA sense region
  misc_feature (1)..(4): 2'-deoxy-2'-fluoro
  misc_feature (1)..(1): 5'-3 attached terminal deoxyabasic
  misc_feature (5)..(10): 2'-deoxy
  misc_feature (11)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (20)..(21): n stands for thymidine
  misc_feature (21)..(21): 3'-3 attached terminal deoxyabasic
ccccgggaggucucguagann

SEQ ID NO: 1554 - DNA, 21 bp, Artificial Sequence
  Synthetic siNA sense region
  misc_feature (1)..(1): 5'-3 attached terminal deoxyabasic
  misc_feature (1)..(3): 2'-deoxy
  misc_feature (4)..(4): 2'-deoxy-2'-fluoro
  misc_feature (5)..(5): 2'-deoxy
  misc_feature (6)..(9): 2'-deoxy-2'-fluoro
  misc_feature (10)..(15): 2'-deoxy
  misc_feature (16)..(19): 2'-deoxy-2'-fluoro
  misc_feature (20)..(21): n stands for thymidine
  misc_feature (21)..(21): 3'-3 attached terminal deoxyabasic
agaugcucuggagggccccnn

SEQ ID NO: 1555 - DNA, 21 bp, Artificial Sequence
  Synthetic siNA antisense region
  misc_feature (1)..(4): 2'-O-methyl
  misc_feature (5)..(10): 2'-deoxy-2'-fluoro
  misc_feature (11)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (20)..(20): Phosphorothioate 3'-Internucleotide Linkage
  misc_feature (20)..(21): n stands for thymidine
ggggcccuccagagcaucunn

SEQ ID NO: 1556 - DNA, 21 bp, Artificial Sequence
  Synthetic siNA antisense region
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(9): 2'-deoxy
  misc_feature (10)..(15): 2'-deoxy-2'-fluoro
  misc_feature (16)..(19): 2'-deoxy
  misc_feature (20)..(21): n stands for thymidine
  misc_feature (20)..(20): Phosphorothioate 3'-Internucleotide Linkage
ucuacgagaccucccggggnn

SEQ ID NO: 1557 - DNA, 21 bp, Artificial Sequence
  Synthetic siNA antisense region
  misc_feature (5)..(10): 2'-deoxy-2'-fluoro
  misc_feature (11)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (20)..(20): Phosphorothioate 3'-Internucleotide Linkage
  misc_feature (20)..(21): n stands for thymidine
ggggcccuccagagcaucunn

SEQ ID NO: 1558 - DNA, 21 bp, Artificial Sequence
  Synthetic siNA sense region
  misc_feature (1)..(1): 5'-3 attached terminal deoxyabasic moiety
  misc_feature (3)..(3): 2'-deoxy-2'-fluoro
  misc_feature (6)..(8): 2'-deoxy-2'-fluoro
  misc_feature (10)..(10): 2'-deoxy-2'-fluoro
  misc_feature (15)..(16): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
aguggucugcggaaccggunn

SEQ ID NO: 1559 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (4)..(4): 2'-deoxy-2'-fluoro
  misc_feature (9)..(10): 2'-deoxy-2'-fluoro
  misc_feature (13)..(13): 2'-deoxy-2'-fluoro
  misc_feature (17)..(17): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
cugcggaaccggugaguacnn

SEQ ID NO: 1560 - DNA, 21 bp, Artificial Sequence
  Synthetic siNA sense region
  misc_feature (1)..(1): 5'-3 attached terminal deoxyabasic moiety
  misc_feature (4)..(7): 2'-deoxy-2'-fluoro
  misc_feature (9)..(9): 2'-deoxy-2'-fluoro
  misc_feature (12)..(12): 2'-deoxy-2'-fluoro
  misc_feature (14)..(15): 2'-deoxy-2'-fluoro
  misc_feature (17)..(19): 2'-deoxy-2'-fluoro
  misc_feature (20)..(21): n stands for thymidine
  misc_feature (21)..(21): 3'-3 attached terminal deoxyabasic moiety
aggccuugugguacugccunn

SEQ ID NO: 1561 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy-2'-fluoro
  misc_feature (5)..(5): 2'-deoxy-2'-fluoro
  misc_feature (8)..(8): 2'-deoxy-2'-fluoro
  misc_feature (13)..(15): 2'-deoxy-2'-fluoro
  misc_feature (18)..(18): 2'-deoxy-2'-fluoro
  misc_feature (20)..(21): n stands for thymidine
  misc_feature (21)..(21): 3'-3 attached terminal deoxyabasic moiety
cuugugguacugccugauann

SEQ ID NO: 1562 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (4)..(4): 2'-deoxy-2'-fluoro
  misc_feature (6)..(7): 2'-deoxy-2'-fluoro
  misc_feature (9)..(11): 2'-deoxy-2'-fluoro
  misc_feature (14)..(14): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
ugguacugccugauagggunn

SEQ ID NO: 1563 - DNA, 21 bp, Artificial Sequence
  Synthetic siNA sense region
  misc_feature (1)..(1): 5'-3 attached terminal deoxyabasic moiety
  misc_feature (3)..(3): 2'-deoxy-2'-fluoro
  misc_feature (5)..(6): 2'-deoxy-2'-fluoro
  misc_feature (8)..(10): 2'-deoxy-2'-fluoro
  misc_feature (13)..(13): 2'-deoxy-2'-fluoro
  misc_feature (18)..(18): 2'-deoxy-2'-fluoro
  misc_feature (20)..(21): n stands for thymidine
  misc_feature (21)..(21): 3'-3 attached terminal deoxyabasic moiety
gguacugccugauagggugnn

SEQ ID NO: 1564 - DNA, 21 bp, Artificial Sequence
  Synthetic siNA sense region
  misc_feature (1)..(1): 5'-3 attached terminal deoxyabasic moiety
  misc_feature (2)..(2): 2'-deoxy-2'-fluoro
  misc_feature (4)..(5): 2'-deoxy-2'-fluoro
  misc_feature (7)..(9): 2'-deoxy-2'-fluoro
  misc_feature (12)..(12): 2'-deoxy-2'-fluoro
  misc_feature (17)..(17): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
guacugccugauagggugcnn

SEQ ID NO: 1565 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (4)..(6): 2'-deoxy-2'-fluoro
  misc_feature (9)..(9): 2'-deoxy-2'-fluoro
  misc_feature (14)..(14): 2'-deoxy-2'-fluoro
  misc_feature (16)..(18): 2'-deoxy-2'-fluoro
  misc_feature (20)..(21): n stands for thymidine
  misc_feature (21)..(21): 3'-3 attached terminal deoxyabasic moiety
uacugccugauagggugcunn

SEQ ID NO: 1566 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (3)..(5): 2'-deoxy-2'-fluoro
  misc_feature (8)..(8): 2'-deoxy-2'-fluoro
  misc_feature (13)..(13): 2'-deoxy-2'-fluoro
  misc_feature (15)..(17): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
cugccugauagggugcuugnn

SEQ ID NO: 1567 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (3)..(5): 2'-deoxy-2'-fluoro
  misc_feature (8)..(8): 2'-deoxy-2'-fluoro
  misc_feature (13)..(13): 2'-deoxy-2'-fluoro
  misc_feature (15)..(17): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
ugccugauagggugcuugcnn

SEQ ID NO: 1568 - DNA, 21 bp, Artificial Sequence
  Synthetic siNA sense region
  misc_feature (1)..(3): 2'-deoxy-2'-fluoro
  misc_feature (1)..(1): 5'-3 attached terminal deoxyabasic moiety
  misc_feature (6)..(6): 2'-deoxy-2'-fluoro
  misc_feature (11)..(11): 2'-deoxy-2'-fluoro
  misc_feature (13)..(15): 2'-deoxy-2'-fluoro
  misc_feature (17)..(17): 2'-deoxy-2'-fluoro
  misc_feature (17)..(17): n stands for thymidine
  misc_feature (20)..(21): n stands for thymidine
  misc_feature (21)..(21): 3'-3 attached terminal deoxyabasic moiety
ccugauagggugcuugcgann

SEQ ID NO: 1569 - DNA, 21 bp, Artificial Sequence
  Synthetic siNA sense region
  misc_feature (1)..(1): 5'-3 attached terminal deoxyabasic moiety
  misc_feature (3)..(3): 2'-deoxy-2'-fluoro
  misc_feature (8)..(8): 2'-deoxy-2'-fluoro
  misc_feature (14)..(14): 2'-deoxy-2'-fluoro
  misc_feature (18)..(18): 2'-deoxy-2'-fluoro
  misc_feature (20)..(21): n stands for thymidine
  misc_feature (21)..(21): 3'-3 attached terminal deoxyabasic moiety
gauagggugcuugcgagugnn

SEQ ID NO: 1570 - DNA, 21 bp, Artificial Sequence
  Synthetic siNA antisense region
  misc_feature (2)..(3): 2'-deoxy-2'-fluoro
  misc_feature (6)..(9): 2'-deoxy-2'-fluoro
  misc_feature (11)..(11): 2'-deoxy-2'-fluoro
  misc_feature (15)..(16): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (20)..(21): n stands for thymidine
accgguuccgcagaccacunn

SEQ ID NO: 1571 - DNA, 21 bp, Artificial Sequence
  Synthetic siNA antisense region
  misc_feature (2)..(2): 2'-deoxy-2'-fluoro
  misc_feature (4)..(6): 2'-deoxy-2'-fluoro
  misc_feature (8)..(9): 2'-deoxy-2'-fluoro
  misc_feature (12)..(15): 2'-deoxy-2'-fluoro
  misc_feature (17)..(17): 2'-deoxy-2'-fluoro
  misc_feature (20)..(21): n stands for thymidine
  misc_feature (20)..(20): Phosphorothioate 3'-Internucleotide Linkage
guacucaccgguuccgcagnn

SEQ ID NO: 1572 - DNA, 21 bp, Artificial Sequence
  Synthetic siNA antisense region
  misc_feature (4)..(4): 2'-deoxy-2'-fluoro
  misc_feature (7)..(7): 2'-deoxy-2'-fluoro
  misc_feature (9)..(10): 2'-deoxy-2'-fluoro
  misc_feature (12)..(12): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (20)..(21): Phosphorothioate 3'-Internucleotide Linkage
aggcaguaccacaaggccunn

SEQ ID NO: 1573 - DNA, 21 bp, Artificial Sequence
  Synthetic siNA antisense region
  misc_feature (1)..(1): 2'-deoxy-2'-fluoro
  misc_feature (3)..(4): 2'-deoxy-2'-fluoro
  misc_feature (8)..(8): 2'-deoxy-2'-fluoro
  misc_feature (11)..(11): 2'-deoxy-2'-fluoro
  misc_feature (13)..(14): 2'-deoxy-2'-fluoro
  misc_feature (16)..(16): 2'-deoxy-2'-fluoro
  misc_feature (20)..(21): n stands for thymidine
  misc_feature (20)..(20): Phosphorothioate 3'-Internucleotide Linkage
uaucaggcaguaccacaagnn

SEQ ID NO: 1574 - DNA, 21 bp, Artificial Sequence
  Synthetic siNA antisense region
  misc_feature (2)..(5): 2'-deoxy-2'-fluoro
  misc_feature (7)..(8): 2'-deoxy-2'-fluoro
  misc_feature (12)..(12): 2'-deoxy-2'-fluoro
  misc_feature (15)..(15): 2'-deoxy-2'-fluoro
  misc_feature (17)..(18): 2'-deoxy-2'-fluoro
  misc_feature (20)..(20): Phosphorothioate 3'-Internucleotide Linkage
  misc_feature (20)..(21): n stands for thymidine
acccuaucaggcaguaccann

SEQ ID NO: 1575 - DNA, 21 bp, Artificial Sequence
  Synthetic siNA antisense region
  misc_feature (1)..(1): 2'-deoxy-2'-fluoro
  misc_feature (3)..(6): 2'-deoxy-2'-fluoro
  misc_feature (8)..(9): 2'-deoxy-2'-fluoro
  misc_feature (13)..(13): 2'-deoxy-2'-fluoro
  misc_feature (16)..(16): 2'-deoxy-2'-fluoro
  misc_feature (18)..(19): 2'-deoxy-2'-fluoro
  misc_feature (20)..(21): n stands for thymidine
  misc_feature (20)..(20): Phosphorothioate 3'-Internucleotide Linkage
cacccuaucaggcaguaccnn

SEQ ID NO: 1576 - DNA, 21 bp, Artificial Sequence
  Synthetic siNA antisense region
  misc_feature (2)..(2): 2'-deoxy-2'-fluoro
  misc_feature (4)..(7): 2'-deoxy-2'-fluoro
  misc_feature (9)..(10): 2'-deoxy-2'-fluoro
  misc_feature (14)..(14): 2'-deoxy-2'-fluoro
  misc_feature (17)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (20)..(21): n stands for thymidine
gcacccuaucaggcaguacnn

SEQ ID NO: 1577 - DNA, 21 bp, Artificial Sequence
  Synthetic siNA antisense region
  misc_feature (3)..(3): 2'-deoxy-2'-fluoro
  misc_feature (5)..(8): 2'-deoxy-2'-fluoro
  misc_feature (10)..(11): 2'-deoxy-2'-fluoro
  misc_feature (15)..(15): 2'-deoxy-2'-fluoro
  misc_feature (18)..(18): 2'-deoxy-2'-fluoro
  misc_feature (20)..(21): n stands for thymidine
  misc_feature (20)..(20): Phosphorothioate 3'-Internucleotide Linkage
agcacccuaucaggcaguann

SEQ ID NO: 1578 - DNA, 21 bp, Artificial Sequence
  Synthetic siNA antisense region
  misc_feature (1)..(1): 2'-deoxy-2'-fluoro
  misc_feature (5)..(5): 2'-deoxy-2'-fluoro
  misc_feature (7)..(10): 2'-deoxy-2'-fluoro
  misc_feature (12)..(13): 2'-deoxy-2'-fluoro
  misc_feature (17)..(17): 2'-deoxy-2'-fluoro
  misc_feature (20)..(20): Phosphorothioate 3'-Internucleotide Linkage
  misc_feature (20)..(21): n stands for thymidine
caagcacccuaucaggcagnn

SEQ ID NO: 1579 - DNA, 21 bp, Artificial Sequence
  Synthetic siNA antisense region
  misc_feature (2)..(2): 2'-deoxy-2'-fluoro
  misc_feature (6)..(6): 2'-deoxy-2'-fluoro
  misc_feature (8)..(11): 2'-deoxy-2'-fluoro
  misc_feature (13)..(14): 2'-deoxy-2'-fluoro
  misc_feature (18)..(18): 2'-deoxy-2'-fluoro
  misc_feature (20)..(21): n stands for thymidine
  misc_feature (20)..(20): Phosphorothioate 3'-Internucleotide Linkage
gcaagcacccuaucaggcann

SEQ ID NO: 1580 - DNA, 21 bp, Artificial Sequence
  Synthetic siNA antisense region
  misc_feature (1)..(2): 2'-deoxy-2'-fluoro
  misc_feature (4)..(4): 2'-deoxy-2'-fluoro
  misc_feature (8)..(8): 2'-deoxy-2'-fluoro
  misc_feature (10)..(13): 2'-deoxy-2'-fluoro
  misc_feature (15)..(16): 2'-deoxy-2'-fluoro
  misc_feature (20)..(20): Phosphorothioate 3'-Internucleotide Linkage
  misc_feature (20)..(21): n stands for thymidine
ucgcaagcacccuaucaggnn

SEQ ID NO: 1581 - DNA, 21 bp, Artificial Sequence
  Synthetic siNA antisense region
  misc_feature (1)..(1): 2'-deoxy-2'-fluoro
  misc_feature (3)..(5): 2'-deoxy-2'-fluoro
  misc_feature (7)..(7): 2'-deoxy-2'-fluoro
  misc_feature (11)..(11): 2'-deoxy-2'-fluoro
  misc_feature (13)..(16): 2'-deoxy-2'-fluoro
  misc_feature (18)..(19): 2'-deoxy-2'-fluoro
  misc_feature (20)..(21): n stands for thymidine
  misc_feature (20)..(20): Phosphorothioate 3'-Internucleotide Linkage
cacucgcaagcacccuaucnn

SEQ ID NO: 1582 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (4)..(5): 2'-deoxy-2'-fluoro
  misc_feature (10)..(14): 2'-deoxy-2'-fluoro
  misc_feature (17)..(17): 2'-deoxy-2'-fluoro
  misc_feature (20)..(21): n stands for thymidine
  misc_feature (21)..(21): 3'-3 attached terminal deoxyabasic moiety
uggccaaggcgucuggugann

SEQ ID NO: 1583 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (3)..(3): 2'-deoxy-2'-fluoro
  misc_feature (7)..(7): 2'-deoxy-2'-fluoro
  misc_feature (10)..(11): 2'-deoxy-2'-fluoro
  misc_feature (16)..(16): 2'-deoxy-2'-fluoro
  misc_feature (18)..(19): 2'-deoxy-2'-fluoro
  misc_feature (20)..(21): n stands for thymidine
  misc_feature (20)..(21): n stands for thymidine
  misc_feature (21)..(21): 3'-3 attached terminal deoxyabasic moiety
caugaguggccaaggcgucnn

SEQ ID NO: 1584 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy-2'-fluoro
  misc_feature (5)..(6): 2'-deoxy-2'-fluoro
  misc_feature (8)..(8): 2'-deoxy-2'-fluoro
  misc_feature (11)..(11): 2'-deoxy-2'-fluoro
  misc_feature (13)..(16): 2'-deoxy-2'-fluoro
  misc_feature (20)..(21): n stands for thymidine
  misc_feature (21)..(21): 3'-3 attached terminal deoxyabasic moiety
uccgucaugguguuccggann

SEQ ID NO: 1585 - DNA, 21 bp, Artificial Sequence
  Synthetic siNA sense region
  misc_feature (1)..(1): 5'-3 attached terminal deoxyabasic moiety
  misc_feature (2)..(2): 2'-deoxy-2'-fluoro
  misc_feature (5)..(7): 2'-deoxy-2'-fluoro
  misc_feature (9)..(10): 2'-deoxy-2'-fluoro
  misc_feature (12)..(12): 2'-deoxy-2'-fluoro
  misc_feature (15)..(15): 2'-deoxy-2'-fluoro
  misc_feature (17)..(19): 2'-deoxy-2'-fluoro
  misc_feature (20)..(21): n stands for thymidine
  misc_feature (21)..(21): 3'-3 attached terminal deoxyabasic moiety
auaguccgucaugguguucnn

SEQ ID NO: 1586 - DNA, 21 bp, Artificial Sequence
  Synthetic siNA sense region 220>
  misc_feature (1)..(1): 5'-3 attached terminal deoxyabasic moiety
  misc_feature (1)..(1): 2'-deoxy-2'-fluoro
  misc_feature (6)..(6): 2'-deoxy-2'-fluoro
  misc_feature (9)..(11): 2'-deoxy-2'-fluoro
  misc_feature (13)..(14): 2'-deoxy-2'-fluoro
  misc_feature (16)..(16): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
ugggauaguccgucauggunn

SEQ ID NO: 1587 - DNA, 21 bp, Artificial Sequence
  Synthetic siNA sense region
  misc_feature (1)..(1): 5'-3 attached terminal deoxyabasic moiety
  misc_feature (2)..(2): 2'-deoxy-2'-fluoro
  misc_feature (7)..(7): 2'-deoxy-2'-fluoro
  misc_feature (10)..(12): 2'-deoxy-2'-fluoro
  misc_feature (14)..(15): 2'-deoxy-2'-fluoro
  misc_feature (17)..(17): 2'-deoxy-2'-fluoro
  misc_feature (20)..(21): n stands for thymidine
  misc_feature (21)..(21): 3'-3 attached terminal deoxyabasic moiety
gugggauaguccgucauggnn

SEQ ID NO: 1588 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (3)..(3): 2'-deoxy-2'-fluoro
  misc_feature (8)..(8): 2'-deoxy-2'-fluoro
  misc_feature (11)..(13): 2'-deoxy-2'-fluoro
  misc_feature (15)..(16): 2'-deoxy-2'-fluoro
  misc_feature (18)..(18): 2'-deoxy-2'-fluoro
  misc_feature (20)..(21): n stands for thymidine
  misc_feature (21)..(21): 3'-3 attached terminal deoxyabasic moiety
cgugggauaguccgucaugnn

SEQ ID NO: 1589 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (4)..(4): 2'-deoxy-2'-fluoro
  misc_feature (9)..(9): 2'-deoxy-2'-fluoro
  misc_feature (12)..(14): 2'-deoxy-2'-fluoro
  misc_feature (16)..(17): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
ucgugggauaguccgucaunn

SEQ ID NO: 1590 - DNA, 21 bp, Artificial Sequence
  Synthetic siNA sense region
  misc_feature (1)..(1): 5'-3 attached terminal deoxyabasic moiety
  misc_feature (2)..(4): 2'-deoxy-2'-fluoro
  misc_feature (6)..(6): 2'-deoxy-2'-fluoro
  misc_feature (11)..(11): 2'-deoxy-2'-fluoro
  misc_feature (14)..(16): 2'-deoxy-2'-fluoro
  misc_feature (18)..(19): 2'-deoxy-2'-fluoro
  misc_feature (20)..(21): n stands for thymidine
  misc_feature (21)..(21): 3'-3 attached terminal deoxyabasic moiety
guucgugggauaguccgucnn

SEQ ID NO: 1591 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (3)..(5): 2'-deoxy-2'-fluoro
  misc_feature (7)..(7): 2'-deoxy-2'-fluoro
  misc_feature (12)..(12): 2'-deoxy-2'-fluoro
  misc_feature (15)..(17): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
cguucgugggauaguccgunn

SEQ ID NO: 1592 - DNA, 21 bp, Artificial Sequence
  Synthetic siNA sense region
  misc_feature (1)..(1): 5'-3 attached terminal deoxyabasic moiety
  misc_feature (3)..(3): 2'-deoxy-2'-fluoro
  misc_feature (5)..(7): 2'-deoxy-2'-fluoro
  misc_feature (9)..(9): 2'-deoxy-2'-fluoro
  misc_feature (14)..(14): 2'-deoxy-2'-fluoro
  misc_feature (17)..(19): 2'-deoxy-2'-fluoro
  misc_feature (20)..(21): n stands for thymidine
  misc_feature (21)..(21): 3'-3 attached terminal deoxyabasic moiety
agcguucgugggauaguccnn

SEQ ID NO: 1593 - DNA, 21 bp, Artificial Sequence
  Synthetic siNA sense region
  misc_feature (1)..(1): 5'-3 attached terminal deoxyabasic moiety
  misc_feature (2)..(2): 2'-deoxy-2'-fluoro
  misc_feature (6)..(6): 2'-deoxy-2'-fluoro
  misc_feature (8)..(10): 2'-deoxy-2'-fluoro
  misc_feature (12)..(12): 2'-deoxy-2'-fluoro
  misc_feature (17)..(17): 2'-deoxy-2'-fluoro
  misc_feature (20)..(21): n stands for thymidine
  misc_feature (21)..(21): 5'-3 attached terminal deoxyabasic moiety
gugagcguucgugggauagnn

SEQ ID NO: 1594 - DNA, 21 bp, Artificial Sequence
  Synthetic siNA antisense region
  misc_feature (1)..(2): 2'-deoxy-2'-fluoro
  misc_feature (4)..(5): 2'-deoxy-2'-fluoro
  misc_feature (9)..(9): 2'-deoxy-2'-fluoro
  misc_feature (11)..(14): 2'-deoxy-2'-fluoro
  misc_feature (17)..(18): 2'-deoxy-2'-fluoro
  misc_feature (20)..(21): n stands for thymidine
  misc_feature (20)..(20): Phosphorothioate 3'-Internucleotide Linkage
ucaccagacgccuuggccann

SEQ ID NO: 1595 - DNA, 21 bp, Artificial Sequence
  Synthetic siNA antisense region
  misc_feature (3)..(3): 2'-deoxy-2'-fluoro
  misc_feature (5)..(8): 2'-deoxy-2'-fluoro
  misc_feature (11)..(12): 2'-deoxy-2'-fluoro
  misc_feature (14)..(16): 2'-deoxy-2'-fluoro
  misc_feature (18)..(18): 2'-deoxy-2'-fluoro
  misc_feature (20)..(20): Phosphorothioate 3'-Internucleotide Linkage
  misc_feature (20)..(21): n stands for thymidine
gacgccuuggccacucaugnn

SEQ ID NO: 1596 - DNA, 21 bp, Artificial Sequence
  Synthetic siNA antisense region
  misc_feature (1)..(3): 2'-deoxy-2'-fluoro
  misc_feature (6)..(16): 2'-deoxy-2'-fluoro
  misc_feature (8)..(8): 2'-deoxy-2'-fluoro
  misc_feature (10)..(11): 2'-deoxy-2'-fluoro
  misc_feature (13)..(13): 2'-deoxy-2'-fluoro
  misc_feature (20)..(20): Phosphorothioate 3'-Internucleotide Linkage
  misc_feature (20)..(21): n stands for thymidine
uccggaacaccaugacggann

SEQ ID NO: 1597 - DNA, 21 bp, Artificial Sequence
  Synthetic siNA antisense region
  misc_feature (4)..(4): 2'-deoxy-2'-fluoro
  misc_feature (6)..(7): 2'-deoxy-2'-fluoro
  misc_feature (9)..(9): 2'-deoxy-2'-fluoro
  misc_feature (12)..(12): 2'-deoxy-2'-fluoro
  misc_feature (16)..(17): 2'-deoxy-2'-fluoro
  misc_feature (19)..(19): 2'-deoxy-2'-fluoro
  misc_feature (20)..(21): n stands for thymidine
  misc_feature (20)..(20): Phosphorothioate 3'-Internucleotide Linkage
gaacaccaugacggacuaunn

SEQ ID NO: 1598 - DNA, 21 bp, Artificial Sequence
  Synthetic siNA antisense region
  misc_feature (2)..(3): 2'-deoxy-2'-fluoro
  misc_feature (5)..(5): 2'-deoxy-2'-fluoro
  misc_feature (8)..(8): 2'-deoxy-2'-fluoro
  misc_feature (12)..(13): 2'-deoxy-2'-fluoro
  misc_feature (15)..(18): 2'-deoxy-2'-fluoro
  misc_feature (20)..(21): n stands for thymidine
  misc_feature (20)..(20): Phosphorothioate 3'-Internucleotide Linkage
accaugacggacuaucccann

SEQ ID NO: 1599 - DNA, 21 bp, Artificial Sequence
  Synthetic siNA antisense region
  misc_feature (1)..(2): 2'-deoxy-2'-fluoro
  misc_feature (4)..(4): 2'-deoxy-2'-fluoro
  misc_feature (7)..(7): 2'-deoxy-2'-fluoro
  misc_feature (11)..(12): 2'-deoxy-2'-fluoro
  misc_feature (14)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (20)..(21): n stands for thymidine
ccaugacggacuaucccacnn

SEQ ID NO: 1600 - DNA, 21 bp, Artificial Sequence
  Synthetic siNA antisense region
  misc_feature (1)..(1): 2'-deoxy-2'-fluoro
  misc_feature (3)..(3): 2'-deoxy-2'-fluoro
  misc_feature (6)..(6): 2'-deoxy-2'-fluoro
  misc_feature (10)..(11): 2'-deoxy-2'-fluoro
  misc_feature (13)..(16): 2'-deoxy-2'-fluoro
  misc_feature (18)..(18): 2'-deoxy-2'-fluoro
  misc_feature (20)..(21): n stands for thymidine
  misc_feature (20)..(20): Phosphorothioate 3'-Internucleotide Linkage
caugacggacuaucccacgnn

SEQ ID NO: 1601 - DNA, 21 bp, Artificial Sequence
  Synthetic siNA antisense region
  misc_feature (2)..(2): 2'-deoxy-2'-fluoro
  misc_feature (5)..(5): 2'-deoxy-2'-fluoro
  misc_feature (9)..(10): 2'-deoxy-2'-fluoro
  misc_feature (12)..(15): 2'-deoxy-2'-fluoro
  misc_feature (17)..(17): 2'-deoxy-2'-fluoro
  misc_feature (20)..(20): Phosphorothioate 3'-Internucleotide Linkage
  misc_feature (20)..(21): n stands for thymidine
  misc_feature (20)..(21): n stands for thymidine
  misc_feature (20)..(20): Phosphorothioate 3'-Internucleotide Linkage
augacggacuaucccacgann

SEQ ID NO: 1602 - DNA, 21 bp, Artificial Sequence
  Synthetic siNA antisense region
  misc_feature (3)..(3): 2'-deoxy-2'-fluoro
  misc_feature (7)..(8): 2'-deoxy-2'-fluoro
  misc_feature (10)..(13): 2'-deoxy-2'-fluoro
  misc_feature (15)..(15): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (20)..(21): n stands for thymidine
gacggacuaucccacgaacnn

SEQ ID NO: 1603 - DNA, 21 bp, Artificial Sequence
  Synthetic siNA antisense region
  misc_feature (2)..(2): 2'-deoxy-2'-fluoro
  misc_feature (6)..(7): 2'-deoxy-2'-fluoro
  misc_feature (9)..(12): 2'-deoxy-2'-fluoro
  misc_feature (14)..(14): 2'-deoxy-2'-fluoro
  misc_feature (18)..(18): 2'-deoxy-2'-fluoro
  misc_feature (20)..(21): n stands for thymidine
  misc_feature (20)..(20): Phosphorothioate 3'-Internucleotide Linkage
  misc_feature (20)..(20): Phosphorothioate 3'-Internucleotide Linkage
acggacuaucccacgaacgnn

SEQ ID NO: 1604 - DNA, 21 bp, Artificial Sequence
  Synthetic siNA antisense region
  misc_feature (4)..(5): 2'-deoxy-2'-fluoro
  misc_feature (7)..(10): 2'-deoxy-2'-fluoro
  misc_feature (12)..(12): 2'-deoxy-2'-fluoro
  misc_feature (16)..(16): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (20)..(21): n stands for thymidine
ggacuaucccacgaacgcunn

SEQ ID NO: 1605 - DNA, 21 bp, Artificial Sequence
  Synthetic siNA antisense region
  misc_feature (1)..(2): 2'-deoxy-2'-fluoro
  misc_feature (4)..(7): 2'-deoxy-2'-fluoro
  misc_feature (9)..(9): 2'-deoxy-2'-fluoro
  misc_feature (13)..(13): 2'-deoxy-2'-fluoro
  misc_feature (15)..(17): 2'-deoxy-2'-fluoro
  misc_feature (19)..(19): 2'-deoxy-2'-fluoro
  misc_feature (20)..(21): n stands for thymidine
  misc_feature (20)..(20): Phosphorothioate 3'-Internucleotide Linkage
cuaucccacgaacgcucacnn

SEQ ID NO: 1606 - RNA, 23 nt, Artificial Sequence
  Synthetic Target Sequence/siNA sense region
ggguccuuucuuggaucaacccg

SEQ ID NO: 1607 - RNA, 23 nt, Artificial Sequence
  Synthetic Target Sequence/siNA sense region
cggguccuuucuuggaucaaccc

SEQ ID NO: 1608 - RNA, 23 nt, Artificial Sequence
  Synthetic Target Sequence/siNA sense region
gaccggguccuuucuuggaucaa

SEQ ID NO: 1609 - RNA, 23 nt, Artificial Sequence
  Synthetic Target Sequence/siNA sense region
gccccgggaggucucguagaccg

SEQ ID NO: 1610 - RNA, 23 nt, Artificial Sequence
  Synthetic Target Sequence/siNA sense region
ccccgggaggucucguagaccgu

SEQ ID NO: 1611 - RNA, 23 nt, Artificial Sequence
  Synthetic Target Sequence/siNA sense region
cccgggaggucucguagaccgug

SEQ ID NO: 1612 - RNA, 23 nt, Artificial Sequence
  Synthetic Target Sequence/siNA sense region
ccgggaggucucguagaccgugc

SEQ ID NO: 1613 - DNA, 21 bp, Artificial Sequence
  Synthetic siNA sense region
  misc_feature (1)..(1): 5'-3 attached terminal deoxyabasic moiety
  misc_feature (2)..(10): 2'-deoxy-2'-fluoro
  misc_feature (14)..(15): 2'-deoxy-2'-fluoro
  misc_feature (18)..(19): 2'-deoxy-2'-fluoro
  misc_feature (20)..(21): n stands for thymidine
  misc_feature (21)..(21): 3'-3 attached terminal deoxyabasic moiety
guccuuucuuggaucaaccnn

SEQ ID NO: 1614 - DNA, 21 bp, Artificial Sequence
  Synthetic siNA sense region
  misc_feature (1)..(1): 5'-3 attached terminal deoxyabasic moiety
  misc_feature (1)..(9): 2'-deoxy-2'-fluoro
  misc_feature (13)..(14): 2'-deoxy-2'-fluoro
  misc_feature (17)..(19): 2'-deoxy-2'-fluoro
  misc_feature (20)..(21): n stands for thymidine
  misc_feature (21)..(21): 3'-3 attached terminal deoxyabasic moiety
uccuuucuuggaucaacccnn

SEQ ID NO: 1615 - DNA, 21 bp, Artificial Sequence
  Synthetic siNA sense region
  misc_feature (1)..(1): 5'-3 attached terminal deoxyabasic moiety
  misc_feature (3)..(11): 2'-deoxy-2'-fluoro
  misc_feature (15)..(16): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
gguccuuucuuggaucaacnn

SEQ ID NO: 1616 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (6)..(14): 2'-deoxy-2'-fluoro
  misc_feature (18)..(19): 2'-deoxy-2'-fluoro
  misc_feature (20)..(21): n stands for thymidine
  misc_feature (21)..(21): 3'-3 attached terminal deoxyabasic moiety
ccggguccuuucuuggaucnn

SEQ ID NO: 1617 - DNA, 21 bp, Artificial Sequence
  Synthetic siNA antisense region
  misc_feature (3)..(4): 2'-deoxy-2'-fluoro
  misc_feature (7)..(9): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (20)..(21): n stands for thymidine
gguugauccaagaaaggacnn

SEQ ID NO: 1618 - DNA, 21 bp, Artificial Sequence
  Synthetic siNA antisense region
  misc_feature (4)..(5): 2'-deoxy-2'-fluoro
  misc_feature (8)..(10): 2'-deoxy-2'-fluoro
  misc_feature (20)..(21): n stands for thymidine
  misc_feature (20)..(20): n stands for thymidine
ggguugauccaagaaaggann

SEQ ID NO: 1619 - DNA, 21 bp, Artificial Sequence
  Synthetic siNA antisense region
  misc_feature (2)..(3): 2'-deoxy-2'-fluoro
  misc_feature (6)..(8): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (20)..(21): n stands for thymidine
guugauccaagaaaggaccnn

SEQ ID NO: 1620 - DNA, 21 bp, Artificial Sequence
  Synthetic siNA antisense region
  misc_feature (3)..(5): 2'-deoxy-2'-fluoro
  misc_feature (15)..(17): 2'-deoxy-2'-fluoro
  misc_feature (20)..(21): n stands for thymidine
  misc_feature (20)..(20): Phosphorothioate 3'-Internucleotide Linkage
gauccaagaaaggacccggnn

SEQ ID NO: 1621 - DNA, 21 bp, Artificial Sequence
  Synthetic siNA sense region
  misc_feature (1)..(2): 2'-deoxy-2'-fluoro
  misc_feature (1)..(1): 5'-3 attached terminal deoxyabasic moiety
  misc_feature (5)..(6): 2'-deoxy-2'-fluoro
  misc_feature (10)..(18): 2'-deoxy-2'-fluoro
  misc_feature (20)..(21): n stands for thymidine
  misc_feature (21)..(21): 3'-3 attached terminal deoxyabasic moiety
ccaacuagguucuuuccugnn

SEQ ID NO: 1622 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy-2'-fluoro
  misc_feature (6)..(7): 2'-deoxy-2'-fluoro
  misc_feature (11)..(19): 2'-deoxy-2'-fluoro
  misc_feature (20)..(21): n stands for thymidine
  misc_feature (21)..(21): 3'-3 attached terminal deoxyabasic moiety
cccaacuagguucuuuccunn

SEQ ID NO: 1623 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (4)..(5): 2'-deoxy-2'-fluoro
  misc_feature (9)..(17): 2'-deoxy-2'-fluoro
  misc_feature (20)..(21): n stands for thymidine
  misc_feature (21)..(21): 3'-3 attached terminal deoxyabasic moiety
caacuagguucuuuccuggnn

SEQ ID NO: 1624 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (6)..(14): 2'-deoxy-2'-fluoro
  misc_feature (18)..(19): 2'-deoxy-2'-fluoro
  misc_feature (20)..(21): n stands for thymidine
  misc_feature (21)..(21): 3'-3 attached terminal deoxyabasic moiety
cuagguucuuuccugggccnn

SEQ ID NO: 1625 - DNA, 21 bp, Artificial Sequence
  Synthetic siNA antisense region
  misc_feature (1)..(1): 2'-deoxy-2'-fluoro
  misc_feature (11)..(13): 2'-deoxy-2'-fluoro
  misc_feature (16)..(17): 2'-deoxy-2'-fluoro
  misc_feature (20)..(20): Phosphorothioate 3'-Internucleotide Linkage
  misc_feature (20)..(21): n stands for thymidine
caggaaagaaccuaguuggnn

SEQ ID NO: 1626 - DNA, 21 bp, Artificial Sequence
  Synthetic siNA antisense region
  misc_feature (10)..(12): 2'-deoxy-2'-fluoro
  misc_feature (15)..(16): 2'-deoxy-2'-fluoro
  misc_feature (20)..(21): n stands for thymidine
  misc_feature (20)..(20): Phosphorothioate 3'-Internucleotide Linkage
aggaaagaaccuaguugggnn

SEQ ID NO: 1627 - DNA, 21 bp, Artificial Sequence
  Synthetic siNA antisense region
  misc_feature (1)..(2): 2'-deoxy-2'-fluoro
  misc_feature (12)..(14): 2'-deoxy-2'-fluoro
  misc_feature (17)..(18): 2'-deoxy-2'-fluoro
  misc_feature (20)..(20): Phosphorothioate 3'-Internucleotide Linkage
  misc_feature (20)..(21): n stands for thymidine
ccaggaaagaaccuaguugnn

SEQ ID NO: 1628 - DNA, 21 bp, Artificial Sequence
  Synthetic siNA antisense region
  misc_feature (3)..(5): 2'-deoxy-2'-fluoro
  misc_feature (15)..(17): 2'-deoxy-2'-fluoro
  misc_feature (20)..(21): n stands for thymidine
  misc_feature (20)..(20): Phosphorothioate 3'-Internucleotide Linkage
ggcccaggaaagaaccuagnn

SEQ ID NO: 1629 - DNA, 21 bp, Artificial Sequence
  Synthetic siNA sense region
  misc_feature (1)..(3): 2'-deoxy-2'-fluoro
  misc_feature (1)..(1): 5'-3 attached terminal deoxyabasic moiety
  misc_feature (4)..(9): 2'-deoxy
  misc_feature (10)..(13): 2'-deoxy-2'-fluoro
  misc_feature (14)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
cccgggaggucucguagacnn

SEQ ID NO: 1630 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (3)..(8): 2'-deoxy
  misc_feature (9)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(19): 2'-deoxy-2'-fluoro
  misc_feature (20)..(21): n stands for thymidine
  misc_feature (21)..(21): 3'-3 attached terminal deoxyabasic moiety
ccgggaggucucguagaccnn

SEQ ID NO: 1631 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (2)..(7): 2'-deoxy
  misc_feature (8)..(11): 2'-deoxy-2'-fluoro
  misc_feature (12)..(12): 2'-deoxy
  misc_feature (13)..(13): 2'-deoxy-2'-fluoro
  misc_feature (14)..(16): 2'-deoxy
  misc_feature (17)..(18): 2'-deoxy-2'-fluoro
  misc_feature (19)..(19): 2'-deoxy
  misc_feature (20)..(21): n stands for thymidine
  misc_feature (21)..(21): 3'-3 attached terminal deoxyabasic moiety
cgggaggucucguagaccgnn

SEQ ID NO: 1632 - DNA, 21 bp, Artificial Sequence
  Synthetic siNA sense region
  misc_feature (1)..(1): 5'-3 attached terminal deoxyabasic moiety
  misc_feature (1)..(6): 2'-deoxy
  misc_feature (7)..(10): 2'-deoxy-2'-fluoro
  misc_feature (11)..(11): 2'-deoxy
  misc_feature (12)..(12): 2'-deoxy-2'-fluoro
  misc_feature (13)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
gggaggucucguagaccgunn

SEQ ID NO: 1633 - DNA, 21 bp, Artificial Sequence
  Synthetic siNA antisense region
  misc_feature (2)..(4): 2'-deoxy-2'-fluoro
  misc_feature (5)..(5): 2'-O-methyl
  misc_feature (6)..(6): 2'-deoxy-2'-fluoro
  misc_feature (7)..(10): 2'-O-methyl
  misc_feature (11)..(16): 2'-deoxy-2'-fluoro
  misc_feature (17)..(19): 2'-O-methyl
  misc_feature (20)..(20): Phosphorothioate 3'-Internucleotide Linkage
  misc_feature (20)..(21): n stands for thymidine
gucuacgagaccucccgggnn

SEQ ID NO: 1634 - DNA, 21 bp, Artificial Sequence
  Synthetic siNA antisense region
  misc_feature (1)..(2): 2'-O-methyl
  misc_feature (3)..(5): 2'-deoxy-2'-fluoro
  misc_feature (6)..(6): 2'-O-methyl
  misc_feature (7)..(7): 2'-deoxy-2'-fluoro
  misc_feature (8)..(11): 2'-O-methyl
  misc_feature (12)..(17): 2'-deoxy-2'-fluoro
  misc_feature (18)..(19): 2'-O-methyl
  misc_feature (20)..(21): n stands for thymidine
  misc_feature (20)..(20): Phosphorothioate 3'-Internucleotide Linkage
ggucuacgagaccucccggnn

SEQ ID NO: 1635 - DNA, 21 bp, Artificial Sequence
  Synthetic siNA antisense region
  misc_feature (1)..(1): 2'-deoxy-2'-fluoro
  misc_feature (2)..(3): 2'-O-methyl
  misc_feature (4)..(6): 2'-deoxy-2'-fluoro
  misc_feature (7)..(7): 2'-O-methyl
  misc_feature (8)..(8): 2'-deoxy-2'-fluoro
  misc_feature (9)..(12): 2'-O-methyl
  misc_feature (13)..(18): 2'-deoxy-2'-fluoro
  misc_feature (19)..(19): 2'-O-methyl
  misc_feature (20)..(20): Phosphorothioate 3'-Internucleotide Linkage
  misc_feature (20)..(21): n stands for thymidine
cggucuacgagaccucccgnn

SEQ ID NO: 1636 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(4): 2'-O-methyl
  misc_feature (5)..(7): 2'-deoxy-2'-fluoro
  misc_feature (8)..(8): 2'-O-methyl
  misc_feature (9)..(9): 2'-deoxy-2'-fluoro
  misc_feature (10)..(13): 2'-O-methyl
  misc_feature (14)..(19): 2'-deoxy-2'-fluoro
  misc_feature (20)..(20): Phosphorothioate 3'-Internucleotide Linkage
  misc_feature (20)..(21): n stands for thymidine
acggucuacgagaccucccnn

SEQ ID NO: 1637 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(10): 2'-deoxy-2'-fluoro
  misc_feature (11)..(16): 2'-deoxy
  misc_feature (17)..(19): 2'-deoxy-2'-fluoro
  misc_feature (20)..(21): n stands for thymidine
  misc_feature (21)..(21): 3'-3 attached terminal deoxyabasic moiety
cagaugcucuggagggcccnn

SEQ ID NO: 1638 - DNA, 21 bp, Artificial Sequence
  Synthetic siNA sense region
  misc_feature (1)..(2): 2'-deoxy-2'-fluoro
  misc_feature (1)..(1): 5'-3 attached terminal deoxyabasic moiety
  misc_feature (3)..(5): 2'-deoxy
  misc_feature (6)..(6): 2'-deoxy-2'-fluoro
  misc_feature (7)..(7): 2'-deoxy
  misc_feature (8)..(11): 2'-deoxy-2'-fluoro
  misc_feature (12)..(17): 2'-deoxy
  misc_feature (18)..(19): 2'-deoxy-2'-fluoro
  misc_feature (20)..(21): n stands for thymidine
  misc_feature (21)..(21): 3'-3 attached terminal deoxyabasic moiety
ccagaugcucuggagggccnn

SEQ ID NO: 1639 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(12): 2'-deoxy-2'-fluoro
  misc_feature (13)..(18): 2'-deoxy
  misc_feature (19)..(19): 2'-deoxy-2'-fluoro
  misc_feature (20)..(21): n stands for thymidine
  misc_feature (21)..(21): 3'-3 attached terminal deoxyabasic moiety
gccagaugcucuggagggcnn

SEQ ID NO: 1640 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(7): 2'-deoxy
  misc_feature (8)..(8): 2'-deoxy-2'-fluoro
  misc_feature (9)..(9): 2'-deoxy
  misc_feature (10)..(13): 2'-deoxy-2'-fluoro
  misc_feature (14)..(19): 2'-deoxy
  misc_feature (20)..(21): n stands for thymidine
  misc_feature (21)..(21): 3'-3 attached terminal deoxyabasic moiety
ugccagaugcucuggagggnn

SEQ ID NO: 1641 - DNA, 21 bp, Artificial Sequence
  Synthetic siNA antisense region
  misc_feature (1)..(3): 2'-O-methyl
  misc_feature (4)..(9): 2'-deoxy-2'-fluoro
  misc_feature (10)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (20)..(20): Phosphorothioate 3'-Internucleotide Linkage
  misc_feature (20)..(21): n stands for thymidine
gggcccuccagagcaucugnn

SEQ ID NO: 1642 - DNA, 21 bp, Artificial Sequence
  Synthetic siNA antisense region
  misc_feature (1)..(2): 2'-O-methyl
  misc_feature (3)..(8): 2'-deoxy-2'-fluoro
  misc_feature (9)..(12): 2'-O-methyl
  misc_feature (13)..(13): 2'-deoxy-2'-fluoro
  misc_feature (14)..(14): 2'-O-methyl
  misc_feature (15)..(17): 2'-deoxy-2'-fluoro
  misc_feature (18)..(19): 2'-O-methyl
  misc_feature (20)..(21): n stands for thymidine
  misc_feature (20)..(20): Phosphorothioate 3'-Internucleotide Linkage
ggcccuccagagcaucuggnn

SEQ ID NO: 1643 - DNA, 21 bp, Artificial Sequence
  Synthetic siNA antisense region
  misc_feature (1)..(1): 2'-O-methyl
  misc_feature (2)..(7): 2'-O-methyl
  misc_feature (8)..(11): 2'-O-methyl
  misc_feature (12)..(12): 2'-O-methyl
  misc_feature (13)..(13): 2'-O-methyl
  misc_feature (14)..(16): 2'-O-methyl
  misc_feature (17)..(18): 2'-O-methyl
  misc_feature (19)..(19): 2'-O-methyl
  misc_feature (20)..(20): Phosphorothioate 3'-Internucleotide Linkage
  misc_feature (20)..(21): n stands for thymidine
gcccuccagagcaucuggcnn

SEQ ID NO: 1644 - DNA, 21 bp, Artificial Sequence
  Synthetic siNA antisense region
  misc_feature (1)..(6): 2'-deoxy-2'-fluoro
  misc_feature (7)..(10): 2'-O-methyl
  misc_feature (11)..(11): 2'-deoxy-2'-fluoro
  misc_feature (12)..(12): 2'-O-methyl
  misc_feature (13)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (20)..(21): n stands for thymidine
  misc_feature (20)..(20): Phosphorothioate 3'-Internucleotide Linkage
cccuccagagcaucuggcann

SEQ ID NO: 1645 - DNA, 21 bp, Artificial Sequence
  Synthetic siNA sense region
  misc_feature (1)..(3): 2'-deoxy-2'-fluoro
  misc_feature (4)..(4): 2'-O-methyl
  misc_feature (5)..(5): 2'-deoxy-2'-fluoro
  misc_feature (8)..(8): 2'-deoxy-2'-fluoro
  misc_feature (9)..(9): 2'-O-methyl
  misc_feature (10)..(11): 2'-deoxy-2'-fluoro
  misc_feature (12)..(12): 2'-O-methyl
  misc_feature (13)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (20)..(21): n stands for thymidine
  misc_feature (20)..(20): Phosphorothioate 3'-Internucleotide Linkage
cuugugguacugccugauann

SEQ ID NO: 1646 - DNA, 21 bp, Artificial Sequence
  Synthetic siNA sense region
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(18): 2'-O-methyl
  misc_feature (19)..(19): 2'-deoxy-2'-fluoro
  misc_feature (20)..(20): Phosphorothioate 3'-Internucleotide Linkage
  misc_feature (20)..(21): n stands for thymidine
ugguacugccugauagggunn

SEQ ID NO: 1647 - DNA, 21 bp, Artificial Sequence
  Synthetic siNA sense region
  misc_feature (1)..(4): 2'-deoxy-2'-fluoro
  misc_feature (5)..(10): 2'-O-methyl
  misc_feature (11)..(14): 2'-deoxy-2'-fluoro
  misc_feature (15)..(15): 2'-O-methyl
  misc_feature (16)..(16): 2'-deoxy-2'-fluoro
  misc_feature (17)..(19): 2'-O-methyl
  misc_feature (20)..(21): n stands for thymidine
  misc_feature (20)..(20): Phosphorothioate 3'-Internucleotide Linkage
ccccgggaggucucguagann

SEQ ID NO: 1648 - DNA, 21 bp, Artificial Sequence
  Synthetic siNA sense region
  misc_feature (1)..(1): 2'-O-methyl
  misc_feature (2)..(2): 2'-deoxy-2'-fluoro
  misc_feature (3)..(4): 2'-O-methyl
  misc_feature (5)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (12)..(12): 2'-deoxy-2'-fluoro
  misc_feature (13)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (20)..(20): Phosphorothioate 3'-Internucleotide Linkage
  misc_feature (20)..(21): n stands for thymidine
auaguccgucaugguguucnn

SEQ ID NO: 1649 - DNA, 21 bp, Artificial Sequence
  Synthetic siNA sense region
  misc_feature (1)..(1): 2'-deoxy-2'-fluoro
  misc_feature (2)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): n stands for thymidine
  misc_feature (20)..(20): Phosphorothioate 3'-Internucleotide Linkage
ugggauaguccgucauggunn

SEQ ID NO: 1650 - DNA, 21 bp, Artificial Sequence
  Synthetic siNA sense region
  misc_feature (1)..(3): 2'-O-methyl
  misc_feature (4)..(4): 2'-deoxy-2'-fluoro
  misc_feature (5)..(5): 2'-O-methyl
  misc_feature (6)..(9): 2'-deoxy-2'-fluoro
  misc_feature (10)..(15): 2'-O-methyl
  misc_feature (16)..(19): 2'-deoxy-2'-fluoro
  misc_feature (20)..(21): Phosphorothioate 3'-Internucleotide Linkage
  misc_feature (20)..(21): n stands for thymidine
agaugcucuggagggccccnn

SEQ ID NO: 1651 - DNA, 21 bp, Artificial Sequence
  Synthetic siNA sense region
  misc_feature (1)..(2): 2'-deoxy-2'-fluoro
  misc_feature (3)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(21): n stands for thymidine
  misc_feature (20)..(20): Phosphorothioate 3'-Internucleotide Linkage
ccgggaggucucguagaccnn

SEQ ID NO: 1652 - DNA, 21 bp, Artificial Sequence
  Synthetic siNA sense region
  misc_feature (1)..(2): 2'-deoxy-2'-fluoro
  misc_feature (3)..(5): 2'-O-methyl
  misc_feature (6)..(6): 2'-deoxy-2'-fluoro
  misc_feature (7)..(7): 2'-O-methyl
  misc_feature (8)..(11): 2'-deoxy-2'-fluoro
  misc_feature (12)..(17): 2'-O-methyl
  misc_feature (18)..(19): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (20)..(21): n stands for thymidine
ccagaugcucuggagggccnn

SEQ ID NO: 1653 - DNA, 21 bp, Artificial Sequence
  Synthetic siNA sense region
  misc_feature (1)..(1): 2'-deoxy-2'-fluoro
  misc_feature (2)..(7): 2'-O-methyl
  misc_feature (8)..(11): 2'-deoxy-2'-fluoro
  misc_feature (12)..(12): 2'-O-methyl
  misc_feature (13)..(13): 2'-deoxy-2'-fluoro
  misc_feature (14)..(16): 2'-O-methyl
  misc_feature (17)..(18): 2'-deoxy-2'-fluoro
  misc_feature (19)..(19): 2'-O-methyl
  misc_feature (20)..(21): n stands for thymidine
  misc_feature (20)..(20): Phosphorothioate 3'-Internucleotide Linkage
cgggaggucucguagaccgnn

SEQ ID NO: 1654 - DNA, 21 bp, Artificial Sequence
  Synthetic siNA sense region
  misc_feature (1)..(1): 2'-O-methyl
  misc_feature (2)..(3): 2'-deoxy-2'-fluoro
  misc_feature (4)..(6): 2'-O-methyl
  misc_feature (7)..(7): 2'-deoxy-2'-fluoro
  misc_feature (8)..(8): 2'-O-methyl
  misc_feature (9)..(12): 2'-deoxy-2'-fluoro
  misc_feature (13)..(18): 2'-O-methyl
  misc_feature (19)..(19): 2'-deoxy-2'-fluoro
  misc_feature (20)..(20): Phosphorothioate 3'-Internucleotide Linkage
  misc_feature (20)..(21): n stands for thymidine
gccagaugcucuggagggcnn

SEQ ID NO: 1655 - DNA, 21 bp, Artificial Sequence
  Synthetic siNA sense region
  misc_feature (1)..(2): 2'-deoxy-2'-fluoro
  misc_feature (1)..(1): 5'-3 attached terminal deoxyabasic moiety
  misc_feature (3)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(20): Phosphorothioate 3'-Internucleotide Linkage
  misc_feature (20)..(21): n stands for thymidine
ccgggaggucucguagaccnn

SEQ ID NO: 1656 - DNA, 21 bp, Artificial Sequence
  Synthetic siNA sense region
  misc_feature (1)..(2): 2'-deoxy-2'-fluoro
  misc_feature (3)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(21): n stands for thymidine
  misc_feature (20)..(20): Phosphorothioate 3'-Internucleotide Linkage
  misc_feature (21)..(21): 3'-3 attached terminal deoxyabasic moiety
ccgggaggucucguagaccnn

SEQ ID NO: 1657 - DNA, 21 bp, Artificial Sequence
  Synthetic siNA sense region
  misc_feature (1)..(2): 2'-deoxy-2'-fluoro
  misc_feature (1)..(1): 5'-3 attached terminal deoxyabasic moiety
  misc_feature (3)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(20): Phosphorothioate 3'-Internucleotide Linkage
  misc_feature (20)..(21): n stands for thymidine
  misc_feature (21)..(21): 3'-3 attached terminal deoxyabasic moiety
ccgggaggucucguagaccnn

SEQ ID NO: 1658 - DNA, 34 bp, Artificial Sequence
  Synthetic Single-stranded siNA
  misc_feature (33)..(34): n is a, c, g, or u
ucucguagaccuuggucuacgagaccucccggnn

SEQ ID NO: 1659 - RNA, 32 nt, Artificial Sequence
  Synthetic Single-stranded siNA
  misc_feature (31)..(32): n is a, c, g, or u
ucguagaccuuggucuacgagaccucccggnn

SEQ ID NO: 1660 - RNA, 30 nt, Artificial Sequence
  Synthetic Single-stranded siNA
  misc_feature (29)..(30): n is a, c, g, or u
guagaccuuggucuacgagaccucccggnn

SEQ ID NO: 1661 - RNA, 28 nt, Artificial Sequence
  Synthetic Single-stranded siNA
  misc_feature (27)..(28): n is a, c, g, or u
agaccuuggucuacgagaccucccggnn

SEQ ID NO: 1662 - RNA, 32 nt, Artificial Sequence
  Synthetic Single-stranded siNA
ggucuacgagaccucccgguuccgggaggucu

SEQ ID NO: 1663 - RNA, 30 nt, Artificial Sequence
  Synthetic Single-stranded siNA
ggucuacgagaccucccgguuccgggaggu

SEQ ID NO: 1664 - RNA, 28 nt, Artificial Sequence
  Synthetic Single-stranded siNA
ggucuacgagaccucccgguuccgggag

SEQ ID NO: 1665 - RNA, 26 nt, Artificial Sequence
  Synthetic Single-stranded siNA
ggucuacgagaccucccgguuccggg

SEQ ID NO: 1666 - RNA, 35 nt, Artificial Sequence
  Synthetic Single-stranded siNA
  misc_feature (34)..(35): n is a, c, g, or u
cucguagaccgaaaggucuacgagaccucccggnn

SEQ ID NO: 1667 - RNA, 33 nt, Artificial Sequence
  Synthetic Single-stranded siNA
  misc_feature (32)..(33): n is a, c, g, or u
cguagaccgaaaggucuacgagaccucccggnn

SEQ ID NO: 1668 - RNA, 31 nt, Artificial Sequence
  Synthetic Single-stranded siNA
  misc_feature (30)..(31): n is a, c, g, or u
uagaccgaaaggucuacgagaccucccggnn

SEQ ID NO: 1669 - RNA, 29 nt, Artificial Sequence
  Synthetic Single-stranded siNA
  misc_feature (28)..(29): n is a, c, g, or u
gaccgaaaggucuacgagaccucccggnn

SEQ ID NO: 1670 - RNA, 35 nt, Artificial Sequence
  Synthetic Single-stranded siNA
ggucuacgagaccucccgguugaaaccgggagguc

SEQ ID NO: 1671 - RNA, 33 nt, Artificial Sequence
  Synthetic Single-stranded siNA
ggucuacgagaccucccgguugaaaccgggagg

SEQ ID NO: 1672 - RNA, 31 nt, Artificial Sequence
  Synthetic Single-stranded siNA
ggucuacgagaccucccgguugaaaccggga

SEQ ID NO: 1673 - RNA, 29 nt, Artificial Sequence
  Synthetic Single-stranded siNA
ggucuacgagaccucccgguugaaaccgg

SEQ ID NO: 1674 - RNA, 40 nt, Artificial Sequence
  Synthetic Single-stranded siNA
  misc_feature (39)..(40): n is a, c, g, or u
cguagaccuuuuuguguagggucuacgagaccucccggnn

SEQ ID NO: 1675 - RNA, 38 nt, Artificial Sequence
  Synthetic Single-stranded siNA
  misc_feature (37)..(38): n is a, c, g, or u
uagaccuuuuuguguagggucuacgagaccucccggnn

SEQ ID NO: 1676 - RNA, 36 nt, Artificial Sequence
  Synthetic Single-stranded siNA
  misc_feature (35)..(36): n is a, c, g, or u
gaccuuuuuguguagggucuacgagaccucccggnn

SEQ ID NO: 1677 - RNA, 34 nt, Artificial Sequence
  Synthetic Single-stranded siNA
  misc_feature (33)..(34): n is a, c, g, or u
ccuuuuuguguagggucuacgagaccucccggnn

SEQ ID NO: 1678 - RNA, 40 nt, Artificial Sequence
  Synthetic Single-stranded siNA
ggucuacgagaccucccgguuuuuguguagccgggagguc

SEQ ID NO: 1679 - RNA, 38 nt, Artificial Sequence
  Synthetic Single-stranded siNA
ggucuacgagaccucccgguuuuuguguagccgggagg

SEQ ID NO: 1680 - RNA, 36 nt, Artificial Sequence
  Synthetic Single-stranded siNA
ggucuacgagaccucccgguuuuuguguagccggga

SEQ ID NO: 1681 - RNA, 34 nt, Artificial Sequence
  Synthetic Single-stranded siNA
ggucuacgagaccucccgguuuuuguguagccgg

SEQ ID NO: 1682 - DNA, 18 bp, Artificial Sequence
  Synthetic  Primer
ccggctacctgcccattc

SEQ ID NO: 1683 - DNA, 21 bp, Artificial Sequence
  Synthetic  Primer
ccagatcatcctgatcgacaa

SEQ ID NO: 1684 - DNA, 24 bp, Artificial Sequence
  Synthetic  Primer
acatcgcatcgagcgagcacgtac

SEQ ID NO: 1685 - DNA, 24 bp, Artificial Sequence
  Synthetic  Primer
tctatcatcaacgggtacaaacga

SEQ ID NO: 1686 - DNA, 22 bp, Artificial Sequence
  Synthetic  Primer
cttttcagcaagtgggaaggtg

SEQ ID NO: 1687 - DNA, 27 bp, Artificial Sequence
  Synthetic  Primer
cctggccttgtctgtggagacggatta

SEQ ID NO: 1688 - RNA, 21 nt, Artificial Sequence
  Synthetic  siNA sense region
  misc_feature (1)..(19): ribonucleotide
  misc_feature (1)..(1): 5'-3 attached terminal deoxyabasic moiety
  misc_feature (21)..(21): 3'-3 attached terminal deoxyabasic moiety
  misc_feature (20)..(21): n stands for any nucleotide
nnnnnnnnnnnnnnnnnnnnn

SEQ ID NO: 1689 - RNA, 21 nt, Artificial Sequence
  Synthetic siNA antisense region
  misc_feature (1)..(19): ribonucleotide
  misc_feature (20)..(20): Phosphorothioate 3'-Internucleotide Linkage
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 1690 - RNA, 21 nt, Artificial Sequence
  Synthetic  siNA sense region
  misc_feature (1)..(19): n stands for any nucleotide wherein any pyrimidine nucleotide present is 2'-Fluoro and any purine nuc leotide present is 2'-O-methyl
  misc_feature (20)..(20): Phosphorothioate 3'-Internucleotide Linkage
  misc_feature (20)..(21): n stands for any nucleotide
nnnnnnnnnnnnnnnnnnnnn

SEQ ID NO: 1691 - RNA, 21 nt, Artificial Sequence
  Synthetic siNA antisense region
  misc_feature (1)..(19): n stands for any nucleotide wherein any pyrimidine nucleotide present is 2'-Fluoro and any purine nuc leotide present is 2'-O-methyl
  misc_feature (20)..(20): Phosphorothioate 3'-Internucleotide Linkage
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 1692 - RNA, 21 nt, Artificial Sequence
  Synthetic  siNA sense region
  misc_feature (1)..(19): n stands for any nucleotide wherein any pyrimidine nucleotide present is 2'-O-methyl or 2'-Fluoro
  misc_feature (20)..(21): n stands for any nucleotide
  misc_feature (1)..(1): 5'-3 attached terminal deoxyabasic moiety
  misc_feature (21)..(21): 3'-3 attached terminal deoxyabasic moiety
nnnnnnnnnnnnnnnnnnnnn

SEQ ID NO: 1693 - RNA, 21 nt, Artificial Sequence
  Synthetic siNA antisense region
  misc_feature (1)..(19): n stands for any nucleotide wherein any pyrimidine nucleotide present is 2'-Fluoro
  misc_feature (20)..(20): Phosphorothioate 3'-Internucleotide Linkage
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 1694 - RNA, 21 nt, Artificial Sequence
  Synthetic  siNA sense region
  misc_feature (1)..(19): n stands for any nucleotide wherein any pyrimidine nucleotide present is 2'-Fluoro and any purine nuc leotide present is 2'-Deoxy
  misc_feature (20)..(21): n stands for any nucleotide
  misc_feature (1)..(1): 5'-3 attached terminal deoxyabasic moiety
  misc_feature (21)..(21): 3'-3 attached terminal deoxyabasic moiety
nnnnnnnnnnnnnnnnnnnnn

SEQ ID NO: 1695 - RNA, 21 nt, Artificial Sequence
  Synthetic  siNA sense region
  misc_feature (1)..(19): n stands for any nucleotide wherein any pyrimidine nucleotide present is 2'-Fluoro
  misc_feature (20)..(21): n stands for any nucleotide
  misc_feature (1)..(1): 5'-3 attached terminal deoxyabasic moiety
  misc_feature (21)..(21): 3'-3 attached terminal deoxyabasic moiety
nnnnnnnnnnnnnnnnnnnnn

SEQ ID NO: 1696 - RNA, 21 nt, Artificial Sequence
  Synthetic siNA antisense region
  misc_feature (1)..(19): n stands for any nucleotide wherein any pyrimidine nucleotide present is 2'-Fluoro and any purine nuc leotide present is 2'-Deoxy 220>
  misc_feature (20)..(20): Phosphorothioate 3'-Internucleotide Linkage
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 1697 - DNA, 21 bp, Artificial Sequence
  Synthetic  siNA sense region
  misc_feature (1)..(1): 5'-3 attached terminal deoxyabasic moiety
  misc_feature (21)..(21): 3'-3 attached terminal deoxyabasic moiety
  misc_feature (20)..(21): n stands for thymidine
acaccggaauugccaggacnn

SEQ ID NO: 1698 - DNA, 21 bp, Artificial Sequence
  Synthetic siNA antisense region
  misc_feature (20)..(20): Phosphorothioate 3'-Internucleotide Linkage
  misc_feature (20)..(21): n stands for thymidine
  misc_feature (21)..(21): 3'-3 attached terminal glyceryl moiety
guccuggcaauuccggugunn

SEQ ID NO: 1699 - DNA, 21 bp, Artificial Sequence
  Synthetic  siNA sense region
  misc_feature (1)..(1): 2'-O-Methyl
  misc_feature (2)..(2): 2'-deoxy-2'-fluoro
  misc_feature (3)..(3): 2'-O-Methyl
  misc_feature (4)..(5): 2'-deoxy-2'-fluoro
  misc_feature (6)..(9): 2'-O-Methyl
  misc_feature (10)..(11): 2'-deoxy-2'-fluoro
  misc_feature (11)..(11): 2'-O-Methyl
  misc_feature (12)..(14): 2'-deoxy-2'-fluoro
  misc_feature (12)..(12): 2'-O-Methyl
  misc_feature (13)..(14): 2'-deoxy-2'-fluoro
  misc_feature (15)..(18): 2'-O-Methyl
  misc_feature (19)..(19): 2'-deoxy-2'-fluoro
  misc_feature (20)..(20): Phosphorothioate 3'-Internucleotide Linkage
  misc_feature (20)..(21): n stands for thymidine
acaccggaauugccaggacnn

SEQ ID NO: 1700 - DNA, 21 bp, Artificial Sequence
  Synthetic siNA antisense region
  misc_feature (1)..(1): 2'-O-methyl
  misc_feature (2)..(5): 2'-deoxy-2'-fluoro
  misc_feature (6)..(7): 2'-O-methyl
  misc_feature (8)..(8): 2'-deoxy-2'-fluoro
  misc_feature (9)..(10): 2'-O-methyl
  misc_feature (11)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (20)..(21): n stands for thymidine
  misc_feature (21)..(21): 3'-3 attached terminal glyceryl moiety
guccuggcaauuccggugunn

SEQ ID NO: 1701 - DNA, 21 bp, Artificial Sequence
  Synthetic  siNA sense region
  misc_feature (1)..(1): 5'-3 attached terminal deoxyabasic moiety
  misc_feature (2)..(2): 2'-O-Methyl or 2'-deoxy-2'-fluoro
  misc_feature (4)..(5): 2'-O-Methyl or 2'-deoxy-2'-fluoro
  misc_feature (10)..(11): 2'-O-Methyl or 2'-deoxy-2'-fluoro
  misc_feature (13)..(14): 2'-O-Methyl or 2'-deoxy-2'-fluoro
  misc_feature (19)..(19): 2'-O-Methyl or 2'-deoxy-2'-fluoro
  misc_feature (21)..(21): 3'-3 attached terminal deoxyabasic moiety
  misc_feature (20)..(21): n stands for thymidine
acaccggaauugccaggacnn

SEQ ID NO: 1702 - DNA, 21 bp, Artificial Sequence
  Synthetic siNA antisense region
  misc_feature (2)..(5): 2'-deoxy-2'-fluoro
  misc_feature (8)..(8): 2'-deoxy-2'-fluoro
  misc_feature (11)..(14): 2'-deoxy-2'-fluoro
  misc_feature (17)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (20)..(21): n stands for thymidine
  misc_feature (21)..(21): 3'-3 attached terminal glyceryl moiety
guccuggcaauuccggugunn

SEQ ID NO: 1703 - DNA, 21 bp, Artificial Sequence
  Synthetic  siNA sense region
  misc_feature (1)..(1): 2'-deoxy
  misc_feature (2)..(2): 2'-deoxy-2'-fluoro
  misc_feature (3)..(3): 2'-deoxy
  misc_feature (6)..(9): 2'-deoxy
  misc_feature (12)..(12): 2'-deoxy
  misc_feature (15)..(18): 2'-deoxy
  misc_feature (4)..(5): 2'-deoxy-2'-fluoro
  misc_feature (10)..(11): 2'-deoxy-2'-fluoro
  misc_feature (13)..(14): 2'-deoxy-2'-fluoro
  misc_feature (19)..(19): 2'-deoxy-2'-fluoro
  misc_feature (1)..(1): 5'-3 attached terminal deoxyabasic moiety
  misc_feature (21)..(21): 3'-3 attached terminal deoxyabasic moiety
  misc_feature (20)..(21): n stands for thymidine
acaccggaauugccaggacnn

SEQ ID NO: 1704 - DNA, 21 bp, Artificial Sequence
  Synthetic  siNA sense region
  misc_feature (1)..(1): 5'-3 attached terminal deoxyabasic moiety
  misc_feature (2)..(2): 2'-deoxy-2'-fluoro
  misc_feature (4)..(5): 2'-deoxy-2'-fluoro
  misc_feature (10)..(11): 2'-deoxy-2'-fluoro
  misc_feature (13)..(14): 2'-deoxy-2'-fluoro
  misc_feature (19)..(19): 2'-deoxy-2'-fluoro
  misc_feature (20)..(21): n stands for thymidine
  misc_feature (21)..(21): 3'-3 attached terminal deoxyabasic moiety
acaccggaauugccaggacnn

SEQ ID NO: 1705 - DNA, 21 bp, Artificial Sequence
  Synthetic siNA antisense region
  misc_feature (1)..(1): 2'-deoxy
  misc_feature (6)..(7): 2'-deoxy
  misc_feature (9)..(10): 2'-deoxy
  misc_feature (15)..(16): 2'-deoxy
  misc_feature (18)..(18): 2'-deoxy
  misc_feature (2)..(5): 2'-deoxy-2'-fluoro
  misc_feature (8)..(8): 2'-deoxy-2'-fluoro
  misc_feature (11)..(14): 2'-deoxy-2'-fluoro
  misc_feature (17)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (21)..(21): 3'-3 attached terminal glyceryl moiety
  misc_feature (20)..(21): n stands for thymidine
guccuggcaauuccggugunn

SEQ ID NO: 1706 - RNA, 9436 nt, Homo sapiens
gccagcccccgauugggggcgacacuccaccauagaucacuccccugugaggaacuacugucuucacgcagaaagcgucuagccauggcguuaguaugagugucgugcagccuccaggacccccccucccgggagagccauaguggucugcggaaccggugaguacaccggaauugccaggacgaccggguccuuucuuggaucaacccgcucaaugccuggagauuugggcgugcccccgcgagacugcuagccgaguaguguugggucgcgaaaggccuugugguacugccugauagggugcuugcgagugccccgggaggucucguagaccgugcaccaugagcacgaauccuaaaccucaaagaaaaaccaaacguaacaccuaccgccgcccacaggacgucaaguucccgggcgguggucagaucguugguggaguuuacguguugccgcgcaggggccccacguugggugugcgcgcgacuaggaagacuuccgaacggucgcaaccucguggaaggcgacaaccuauccccaaggcucgccgacccgaggguagggccugggcucagccuggguacccuuggccccucuauggcaaugagggccuggggugggcaggauggcuccugucaccccgcggcucccggccuaguuggggccccacggacccccggcggaggucgcgcaaucuggguaaggucaucgauacccucacgugcggcuucgccgaccucaugggguacauuccgcucgucggcgccccccuagggggcgcugccagggcccuggcacaugguguccggguucuggaggacggcgugaacuacgcaacagggaacuugcccgguugcucuuucucuaucuuccucuuggcccugcuguccuguuugaccaucccagcuuccgcuuaucaggugcgcaacgcauccgggcuguaccaugucacgaaugacugcuccaacucaagcauuguguaugaggcagcgggcaugaucaugcauacccccgggugcguacccugcguucgggagaacaacgccucccguuguuggguagcgcucacucccacgcucgcggccaggaacaccagcauccccacuacgacaauacgacgccacgucgacuugcucguuggggcggccgcuuucuguuccgccauguacgugggggaccucugcggauccguuuuccucgucucccaguuguucaccuucucgccucgccgguaugagacaguacaggacugcaauugcucaaucuaucccggccauguaucaggucaccgcauggcuugggauaugaugaugaacuggucgccuacaacagcccuaguggugucgcaguuacuccggaucccacaagcugucguggauaugguggcgggggcccacuggggaguccuagcgggccuugccuacuauuccaugguggggaacugggcuaaggucuugauugugauguuacucuuugccggcguugacggggucacuuacacgacaggggggucgcaagcucgccacacccagagcgucacguccuucuucacccaagggccggcccagagaauccagcucauaaacaccaauggcagcuggcacaucaacaggacugcccugaacugcaaugaaucccucaacaccggguucuuugccgcacuguucuacgcacacaaguucaacucguccggaugcccagagcgcauggccagcugcagcuccaucgacaaguucgcucagggauggggccccaucaccuauaccgagccuagggaccuggaucagaggccuuacugcuggcauuacgcaccucggcagugugguaucguaccugcgucgcaggugugugguccaguguacuguuucaccccaagcccuguuguaguggggacgaccgaucgguccggugccccuacguauaacuggggggcgaaugagacagaugugcugcuucucaacaacacgcggccgccacaaggcaacugguuuggcuguacauggaugaacagcacuggguucaccaagacgugugggggcccuccgugcaacaucgggggggucggcaaccucaccuugaccugccccacggauugcuuucggaagcaccccgaggccacuuacacaaaauguggcucggggccaugguuaacaccuagguguauaguugacuacccauacaggcucuggcacuaccccugcacugucaacuuuaccaucuuuaagguuaggauguauguggggggcguggagcacaggcuuagugcugcaugcaacuggacucgaggagagcguugcgaccuggaggacagggacagaucggagcucagcccgcugcugcuguccacgacagaguggcagacacuucccuguuccuucaccacccuaccggcucuguccacugguuugauccaccuccaucagaacaucguggacgugcaguaccuguacgguauagggucagcgguugucuccuuugugaucaaaugggaguauaucguguugcuuuuccuucuccuggcggacgcgcgcgucugugccugcuuguggaugaugcugcugauagcccaggcugaggccgcccuagagaaccuggugguccucaacgcggcgucccuggccggagcggauggcauucucuccuuccuuguguuuuucugugccgccugguacaucaagggcaggcuggucccuggggcggcauaugcucuguacggcguguggccgcugcuccugcuccugcuggcguuaccaccacgggcuuacgccauggaccgggagauggcugcaucguguggaggggugguuuuuguaggucuaauacucuugaccuugucaccacacuacaaaguguuccucgccaggcucauauggugguuacaauacuuuaucaccagggccgaggcgcauuugugcguguggguccccccucucaauguccgggggggccgcgaugcuaucauccuccucacaugugcggcccacccagagcuaaucuuugacauuaccaaacuccugcucgccauucucgguccgcucauggugcuccaggcugccauaacugcgaugccguacuuuguacgcgcucaggggcuuauucgugcaugcauguuggugcggaaaguagccggaggccauuacguccaaauggccuucaugaagcuggccgcacugacagguacguacgucuaugaccaucuuaccccgcuacaggauugggcccacgcgggccuacgagaccuugcgguggcaguagagcccgucgucuucucugacauggagaccaagaucaucaccuggggggcggacaccgcggcguguggggacaucaucuugggacugcccgucuccgcccgaaggggaagggagauacuucugggaccggccgauagcauugaagggcagggguggcgacuccuugcccccaucacggccuacgcccaacagacacggggccuacuugguugcauuguuacuagccucacaggccgggacaagaaccaggucgaaggggagguucaagugguuuccaccgcaacacaaucuuuccuggcgaccugcguuaaugguguguguuggaccgucuuccacggcgccggcucaaagacccuagccggcccaaaaggcccaaucacccaaauguacacuaauguagaccaagaccucgucggcuggcaugcgccucccggggcgcguucccuuacaccaugcaccugcgguagcucggaccucuaucuggucacgagacaugcugacgucauuccggugcgccgacgcggugacggucgggggagccuacugucccccagacccgucuccuauuugaagggcucuucggguggcccacugcucugcccuucggggcacgcuguaggcaucuuccgggcugcugugugcacccgggggguugcgaaggcgguggacuucauacccguugagucuauggaaacuacuaugcgguccccggucuucacggacaacucaucucccccggccguaccgcagacauuccaaguggcccaucuacacgcucccacuggcagcggcaagagcacuaaagugccggcugcguacgcagcccaaggguacaagguacucguccugaacccaucuguugccgccaccuuggguuuuggggcguauaugucuaaggcacaugguaccgaccccaacaucagaacugggguaaggaccauuaccacgggcgcccccaucacguacuccaccuaugguaaguuccuugccgacgguggauguucugggggcgccuaugauaucauaauaugugaugagugccacucaacugacucgacuaccauccugggcaucggcacaguccuggaccaagcggagacggcuggagcgcggcucgucgugcucgccaccgcuacgccuccgggaucgguuaccgugccacacccaaauauugaggagguggcucuguccaacacuggagagauccccuucuauggcaaggccaucccccucgaggccaucaaggggggaaggcaucucauuuucugccacuccaagaagaagugcgaugagcucgccgcaaagcugucaggccucggaaucaaugccguagcguauuaccggggucuugacguguccgucauaccgacuagcggagaugucguuaucguggcaacagacgcucuaaugacgggcuacaccggugacuuugacucggugaucgacugcaacacaugugucacccagacagucgauuucagcuuggaucccaccuuuaccauugagacgacgaccgugccccaagacgcggugucgcgcucacaacggcgaggcaggacuggcagggguaggggaggcaucuacagguuugugacuccgggagaacggcccucgggcauguucgauucuucgguccugugugagugcuaugacgcgggcugugcuugguaugagcucacgcccgcugagacuacagucagguugcgggcuuaccugaauacaccaggguugcccgucugccaggaccaucuggaguucugggaaagcgucuucacaggccucacccacauagaugcccacuuccugucccaaaccaagcaggcaggagacaacuucccuuaccugguagcauaccaagccacggugugcgccagggcucaggcuccaccuccaucgugggaucaaauguggaagugucucauacggcuuaaaccuacgcugcacgggccaacaccccugcuguauaggcuaggagccguucaaaaugagaucacccucacacaucccauaaccaaauucaucauggcaugcaugucggccgaccuggaggucgucacuagcaccugggugcugguaggcggaguccuugcagcucuggccgcauauugccugacaaccgguaguguggucauuguggguaggaucauuuuguccgggaggccggcuguuguucccgacagggaaguccucuaccgggaguucgaugaaauggaagagugcgccucacaccucccuuacaucgaacagggaaugcagcucgccgagcaguucaagcagaaggcacucggguugcugcaaacagccaccaagcaagcggaggccgcugcucccgugguggaguccagguggcgggcccuugaggccuucugggcaaagcacauguggaacuucaucagcgggauacaguauuuagcaggcuuauccacucugccugggaaccccgcgauagcaucacugauggcauucacagccucuaucaccaguccgcucaccacccagaauacccuccuguucaacaucuuagggggauggguggcugcucaacucgcuccucccagugcugcuucggccuucgugggcgccggcauugccggugcggccauuggcagcauaggccuugggaaggugcuuguggacauucuggcgggcuauggagcggggguggccggugcacucguggcuuuuaaggucaugagcggcgaggcgcccuccgccgaggaccugguuaacuugcucccugccauccucucccccggcgcccuggucgucggggucgugugugcagcaauccugcgucggcacgugggcccgggagagggggcugugcaguggaugaaccggcugauagcguucgcuucgcgggguaaccacguuucccccacgcacuacgugccugagagcgacgccgcagcacguguaacucagauccucuccagccucaccaucacucagcugcugaagaggcuucaccaguggauuaaugaggacugcuccacgccaugcuccggcucguggcuaaaggauguuugggacuggauaugcacgguguugacugacuucaagaccuggcuccaguccaagcuccugccgaaauugccgggagucccuuucuucucaugccaacgcggguacaagggagucuggcggggggacggcaucaugcaaaccaccugcccauguggagcacaaauuaccggacaugucaaaaacgguuccaugaggaucguugggccuaaaaccugcagcaacacguggcacggaacguuccccaucaacgcguacaccacaggccccugcacacccuccccggcgccgaacuauuccagggcgcuguggcggguggcugcugaagaguacguggagauuacgcgggugggggacuuccacuacgugacggguaugaccaccgacaacguaaaaugcccgugccaggucccggcccccgaauucuucaccgaauuggacggggugcgguugcacagguacgcuccggcgugcagaccucuccuacgggaggaugucacauuccaggucgggcucaaccaauaccugguugggucacagcucccaugcgagccugaaccggauguggcagugcucacuuccaugcucaccgaccccucccacauuacagcagagacggcuaaacguaggcuggccagggggucuccccccuccuuggccagcucuucagcuagccaauugucugcgccuuccuugaaggcaacaugcacuacccaccaugacuccccggacgcugaccucaucgaggccaaccuccuguggcggcaggagaugggcggaaacaucacccguguggagucagagaauaaggugguaauuuuggacucuuucgacccgcuucgagcggaagaggaugagagggaaguauccguugcagcagagauccugcgaaaauccaagaaguucccccccgcguugcccauaugggcacgcccggauuacaacccuccacuguuagaguccuggaaaaguccggacuacgucccuccggcggugcaugggugcccauugccgccuaccacgggcccuccaauaccgccuccacggaaaaagaggacgguuguucugacagaguccaccgugucuucugccuuggcggagcuggcuacuaagacuuucggcagcuccggaucgucggccguugacagcggcacggcgaccgccccucccgaucagaccucugacgacggugacaaagaaucugacguugagucguacuccuccaugcccccccuugagggggagccgggggacccugaucucagcgacgggucuuggucuaccgugagcggggaggccagcgacgacaucgucugcugcucaauguccuacacauggacaggcgcccugaucacgccaugcgccgcagaggagagcaagcugcccaucaacgcguugagcaacucucugcugcgucaccacaacauggucuaugccacaacaucccgcagugcaagccugcggcagaagaaggucaccuuugacagacugcaaguccuggacgaccacuaccgggacgugcucaaggagaugaaggcgaaggcguccacaguuaaggcuaaacuucuauccguagaagaagccugcaagcugacgcccccacauucggccaaaucuaaauuuggcuauggggcaaaggacguccggaaccuauccagcaaggccauuaaccacauccgcuccguguggaaggaccugcuggaagacacugagacaccaauugacaccaccaucauggcaaaaagugaaguuuucugcguccaaccggagaagggaggccgcaagccagcucgccuuaucguauucccagaccugggaguucguguaugcgagaaaauggcucuuuacgacguggucuccacccuuccucaggccgugaugggcuccucguacggauuccaguacucuccugggcagcggguugaguuccuggugaaugccuggaaaucaaagaaaagcccuaugggcuucucguaugacacccgcugcuuugacucaacagucacugagagcgacauccguguugaggagucaaucuaccaauguugugacuuggcccccgaagccagacaggccauaaagucgcucacggagcggcucuacaucgggggcccccugacuaauucaaaagggcagaacugcgguuaucgccggugccgcgcgagcggcgugcugacgacuagcugcggcaauacccucacaugcuacuugaaagccacugcggccugucgagcugcaaagcuccaggacugcacgaugcucgugaacggagacgaccuugucguuaucugugaaagcgcgggaacccaggaggaugcggcgagccuacgagucuucacggaggcuaugacuagguacucugccccccccggggacccgccccaaccagaauacgacuuggaguugauaacaucaugcuccuccaacgugucggucgcgcacgacgcauccggcaaaagaguguacuaccucacucgugaucccaccaccccccuugcacgggcugcgugggagacagcuagacacacuccagucaacuccuggcuaggcaacaucaucauguaugcgcccaccuuaugggcaaggaugauuuugaugacucacuucuucuccauccuucuagcccaggaacagcuugaaaaggcccuggauugucagaucuacggggccuguuacuccauugagccacuugaccuaccucagaucauucaacgacuccauggucuuagcgcauucucacuccauaguuacucuccaggugagaucaauaggguggcuucaugccucaggaaacuugggguaccgcccuugcgagucuggagacaucgggccagaaguguccgcgcuaggcuacugucccaaggggggagggccgccacguguggcaaguaccucuucaacugggcaguaaggaccaagcucaaacucacuccaaucccggccgcgucccagcuggacuuguccagcugguucguugcugguuacagcgggggagacauauaucacagccugucucgugcccgaccccgcugguuuauguggugccuacuccuacuuuccguagggguaggcaucuaccugcuccccaaccggugagcggggagcuaaucacuccaggccaauaggccauccccuuuuuuuuuuuuuuuuuuuuuuuu

The invention claimed is:

1. A chemically modified short interfering nucleic acid (siNA) molecule, wherein:
    (a) the siNA molecule comprises a sense strand and a separate antisense strand, each strand having one or more pyrimidine nucleotides and one or more purine nucleotides;
    (b) each strand is independently 18 to 24 nucleotides in length, and together comprise a duplex having between 17 and 23 base pairs;
    (c) the antisense strand is complementary to a human HCV RNA sequence comprising SEQ ID NO:1706;
    (d) a plurality of the pyrimidine nucleotides present in the sense strand are 2'-deoxy-2'-fluoro pyrimidine nucleotides and a plurality of the purine nucleotides present in the sense strand are 2'-deoxy purine nucleotides; and,
    (e) a plurality of the pyrimidine nucleotides in the antisense strand are 2'-deoxy-2'-fluoro pyrimidine nucleotides and a plurality of the purine nucleotides present in the antisense strand are 2'-O-methyl purine nucleotides.

2. The siNA molecule of claim 1, wherein the sense strand includes a terminal cap moiety at both 5'- and 3'-ends.

3. The siNA molecule of claim 1, wherein the sense strand, the antisense strand, or both the sense strand and the antisense strand comprise a 3'-overhang.

4. A composition comprising the siNA molecule of claim 1 and a pharmaceutically acceptable carrier or diluent.

5. The siNA of claim 1, wherein the antisense strand has a phosphorothioate internucleotide linkage at the 3'-end.

* * * * *